United States Patent 6,974,667 (GENE EXPRESSION PROFILES IN LIVER CANCER) - sequence listing, part 2

SEQ ID NO: 2539 - DNA, 472 bp, Homo sapiens
  Genbank Accession No. N49902
  unsure (1)..(472): n = a or c or g or t
gcaagagagtgacacagattttatttctcccagagaacagacagatgcaatgaagacacatcttatcaatggattttgtttctcaagtcaaagtcagcttttcttaaaccatttccttatgcaagaagatggggagctgaatgtggaaaaatgctcttcaaacaaataatttgataattgccaatgaagagtgttctttcttctcactacagatgaaatacaagagatgtatctaagaccagagcttttactttctctaactggagtgaaattaaaattgatggatattttatttttattttcatttttattttttcttctttttttttcttgtgattgtcttttttattttagccatttaagtacatcaaaaaaaaaggcaacacttcctcaaagtgaataaaaatgggaagaaaaaaaaaaaaaaaaattttccatagggcctagcagnaacttaacacatgccgataat

SEQ ID NO: 2540 - DNA, 549 bp, Homo sapiens
  Genbank Accession No. N50038
  unsure (1)..(549): n = a or c or g or t
gcacaacacaaagagtgaactttaatataaactatgaacactgtagctaataatgaatacaagttcatcagttgtaacaaagtgccatgctaatgcaacatgctaattagagggggaaatatgcaaagaagaggagggatatgggaatccctttgtgcctaatttttctgtaaacataaaactgctcttacaaataaagcctattaattaaaacaacaaaatacaaaacaacaactaaaaccaaaaacagccaacacccaatgggttgagctggagtaagaacaggctgcccagcacacttcctgggccactgagccctgggctngaaaagcaaaagggccagtgaggtttggctgggactcagctccccagcctctggttcaagcccgatttacgaacacaaaggtcatctggttggatttcctggtcccctcagctcactttaaggaggcttttctggtccacagctttgggttgccaaaagcaatctggctaaanggatttgggacatccggctggtgaatgtagggganggtttacccttagatg

SEQ ID NO: 2541 - DNA, 298 bp, Homo sapiens
  Genbank Accession No. N50048
cagaacttaacaaattttaattactttttattgaaaactgcactgaacgctaaatgtccacctttacaataaacaaatacagtaacggtaactcacactaaaacaaaacatacttctgatagccattatttttctgtttgggacaattttaaagtttttcttttgtcacaaaaacaggaatgtacctatacaaaggctcaaaataggccatctttttaaacaaaaaggcaatgattcacaaaagactatgaatagaacatgtaactagttgatacaaatctaataggatttgttaaaa

SEQ ID NO: 2542 - DNA, 413 bp, Homo sapiens
  Genbank Accession No. N51053
  unsure (1)..(413): n = a or c or g or t
tggccagagcaggctttattggggccgtgtaaaccccagggagaggcaggacgtggaccacagagagtcatgtacaggctgcgctttcacttgtcttctctgtctcagtctcctgaagagcccgaggaagtcaagtctccccaccatgagtgaggggtctggtctgacagttgggccttcagagccaggcacgtggaccgtgtcagaagcgccacctggtggtgactgggatgctngcagggaggagctgagggcaaaactctagtggaaatttcccaggtcggtcccacgccccggtgacagggtgaaccctnagaggagcccccaaacttggaggcaattgtctttgaggtaaccactcaccccagcttttcagagaccagaggcaagacatttctggctaagagcatggg

SEQ ID NO: 2543 - DNA, 407 bp, Homo sapiens
  Genbank Accession No. N51117
aaagaaagaggtttaaaatattttattagagaacacatatcaatattgaacaacacttaaatagatggcattcatattaataaggacaatataaattcttataatttgaacagtcagtttgttcaacaaataaaataaattcatttttatcagtgggcatgatccatgaagtatattttttcaataatttattcatctgcttagtactatatacattcattttctttgaaaagaaacataaaatcaacgtgattgtttatctcatcacatcataaacagatggacctgtaaaaatggcgtgtagaaaattcagaaacacttaaacagcacattccaaggatactgagtccatttaagagaaattaaactctttgaagccattggtagtcagcctgggtgtcatatat

SEQ ID NO: 2544 - DNA, 471 bp, Homo sapiens
  Genbank Accession No. N51342
aatttttaaaattaaaaatgttttattggctattgctttaatagatttactacaataaaggaaaggaatatttttctcaaatgtgctaataagaaaaagacccaggaaactgaacgatattggacacagttttcagtgttttagacataaataaactcatgaatttcatatggattctggaatatttaccactactcccctaacgatgcatttagcatagaacaaaaatatgaacatttgaacaagtccaatctaacacatttcaaaacaatcagatctttggaaaactgttttccataagtaccccttgccattcatggaagagttatgaggatgcccatgaatttattcatggacactcccatactaagaaaaagaaaaccatgtagatgggtaatataatttgactatttgttcccgcccaaacctcaagttgaaatgtaatccccaatactggaggtggggcctgga

SEQ ID NO: 2545 - DNA, 269 bp, Homo sapiens
  Genbank Accession No. N51590
  unsure (1)..(269): n = a or c or g or t
aagctttcacaatttttattaaatcctagtctagttgaacaatatctgatgttacagacatcatcccatggtgaacatgtttaataagtgaaagcaagtcagacatctcatctaagncattattttctgcagactaagcaataactacacagaacactatgggtaaacaaacacctgctcagttttcacacaagccatgttgtttatcaaattagatctgcnaatattgnaatacngtagnttccggnggattggaattccccaaaaag

SEQ ID NO: 2546 - DNA, 337 bp, Homo sapiens
  Genbank Accession No. N51737
  unsure (1)..(337): n = a or c or g or t
acatagagaaatatttatataaattatatatatatacatatatatatatatatgcgccacataatcaacagaaagatggggctgtcccagcgtaagtcaggctcgagggagactgatcccctgaccaattcacctgataaactctagggacactggcagctgtggnaangantgnggcacagcntangagctgtggctaagggcaagccccttcctgccccaccccattccttatattcagcaagcaacaaggcaatagaaaagccagggttgtctttatattctttatccccaaataatagggggcttgggaagnagcggtnngagnggcaggaga

SEQ ID NO: 2547 - DNA, 376 bp, Homo sapiens
  Genbank Accession No. N51771
aaagtacagaaaaaaatttattggaaatcccttgaatacattttgaagtgtagctcggtatttccaaacaaagtaggttggagaggttggaggaggaggagggactctgacacctggagacaaacagctggtcccagcctgtcccgggggtgctgcaggagtcagtctagggctcattcctttcatggcaggtctgaggggcaagggctggccttaacagttgctttacttctcccaagctcagctcaaagtcatggctgagactcttcacagatggagccctggtgaaaggctgctgcacctgtagatgccaaagattgctgcctcagacaatggctaggcctttccatgcaaggccttggaaagagagcagtag

SEQ ID NO: 2548 - DNA, 377 bp, Homo sapiens
  Genbank Accession No. N51773
  unsure (1)..(377): n = a or c or g or t
nttgtttnccttaaatgaggagatttaatgtctttacattatacatttcaaaggaacaaaacaccctttatgaattttctcatggagatagcatttacatcacagagctattgtgaaaataaaataagaatgtacagcacacctggaatataaaaaacatcccaataacttacttggagccccgcagccatccatccctcacatataaatacaatgaaccagatgaagatccgtgtccgtgtccatgacagcaatccattcagaagatcaaagataaatagtctaatacaccaatttctgacatttgcttagcactgcaggactcatgaagagctgccactcatattatctcatttaatccctacaacaaaaaccgg

SEQ ID NO: 2549 - DNA, 458 bp, Homo sapiens
  Genbank Accession No. N51855
tagacctgtacagtttttattacataaaatatcacaaaattcacaagtacaacactgcttattttcttgcttgaagatcagatctctggtttatttaagatcaacattcaccacagctgaaggaaattaaactgaacctttaaaaggtaccgcatacggacctggttggggttatatacaatatattcattgtagttgagggtataaccatctggattcagaattcctgtgtcacttgctggtcctaatggcactgtactcccattcctgccaaatggaaaaaaagtgtgtcaacatcagtctctggttcagaagctgcaatagagaacgtagtcttatctggccaaaaggagtcttctagtcctcctggttctgagtacttacagggtgacgaagtgggcagaactgggagccatcttgcccagccccctggtggctatgtttaccctgaagcaatc

SEQ ID NO: 2550 - DNA, 497 bp, Homo sapiens
  Genbank Accession No. N52168
  unsure (1)..(497): n = a or c or g or t
ttacaaccatttgagaaaactattgtttatttagaaaaaaggttacactggtagaattcggcagataaaaaaattctcttttaaaaatgtcactgtgaaacttttccagatgaaagttcagcaatacaaagctcctacagctgtagaattaaaacaattatgttttgatccccccgccgccaagatttgtctaacataattacaagaaaaaatggcaagggacaagtgatcgctggtacctttttcttttttaaacacgtttaatgttgtacatgtactatataaaatgattcctaagcatttcataagacaatgctcccactgcttttagtgactaatattaagaacaagccaaataataaattaaaacagttttaaaatgaggtaaaatccaaaggggttcaacaattggtttattttcagtttccaacaataaaaagggaagcntttcngaatgggaataaaaactggnacccnggccatatttagttaatccc

SEQ ID NO: 2551 - DNA, 509 bp, Homo sapiens
  Genbank Accession No. N52271
  unsure (1)..(509): n = a or c or g or t
tagcacaagggaaaaaaatgggaatttgcctaatataggtgatgaagcatacacaatgaatagaaacaatcacattttagtaaaaggcaaaaatttgagacttataagctatatggtagcttatttttgggtggggaagaaatgagaaaagaatataacatctcttactggcatgacacattttgataaaaaatcttattgtcctttcctactagaatgatccactgtaaggcaaaaataatatacaagcgaagtttttttttggngacacagtntcacnctgtgtncccccaggnctggangtgcagtggtacgatcttggctcactgcaacctctccctcccgggttcaagtgattcncgtgcctcagcctcttggagtagctgggattacaggcgcgtgccactgcgtccggctaatttttggaatttttagtagagatggggtttcaccatgttgggccaggctggttctcaactccgggacctcatgtggtccacccaccttgg

SEQ ID NO: 2552 - DNA, 492 bp, Homo sapiens
  Genbank Accession No. N52322
gagatttgtcacattttattcagtatttctgctgcactgccagcctagggatgcacttgattcccaagaaatgcaactgtcctattcgcagagccgtccacaggtacctaccccctggactgcagcaactttattaccttaactagcacagaacagaggttgatttaaactccttacactcacttctcagatcaatgaatgggcaaagaaacacctcatggctctgggaaggcatgctgagacccgtttttgcaagtcctgaggaatggaagaatatagctgccaggtatcccaagtctagggcagggagggtagtatcggcatcactttcactgcattctgttggtcaacgcaagtcagaggctcagcccagatccaagggcagggaagaggctccatcgtgtagttgggctcacttggaaggtaatgggaggagttggtggctgctttaagacacataccacatctagatttcaacctccagaaaagtcc

SEQ ID NO: 2553 - DNA, 439 bp, Homo sapiens
  Genbank Accession No. N52845
cgggatactttatattctttattatttttatgtacaaccaactctagtgaagaacctaaaaagctacagactaaatttttataaaatctcaggacctaattataagagcccaaacaacggtttagtatcatttagcaagcggggatttttctccctccaaaaacgttaattttgaaaaatatggttaagtttaaaaagttgcaatgtgtaaacggcagttccatgggatgtgaaaacgattatacgttactttcattaaaaaacagcacacttcgaaaaatggattgaagcctgtacaaaaagctatttaacactgattgataaaaaataaaatactttcggaattatgcacaagtatggaagctacattttaaattttcattggtcatgtctaaaacgtacaccattacctttacgttcatttcacttaccaatttat

SEQ ID NO: 2554 - DNA, 476 bp, Homo sapiens
  Genbank Accession No. N52985
  unsure (1)..(476): n = a or c or g or t
ttnggagttacttaagagttttacttattgctgttcttaaattccttcccctaccacttcctcttgggcttttttatttctcttgttgatcaatctcttttttgtgatacttttcattgaatcatctcgactcctttatcccatcctttactcgactcaaactccttatgctgaacttttcaatccaaaatttctattgttttaggactctgggaagcagttgataaaaagataacacgagctactgatatggtcaggagatgttttctaaacaaattgtagaaatataaacatgaaatgtggcaatgatccctttaattagatcattgagcaataaaggatatgaaccattagtataaatattcaattcagtctttccggattgtgttgttagataagaatacatccaaaaagggccacagatcgagggagaaaccaaggaggggtgaggtcatgggttgagtgtaattggttct

SEQ ID NO: 2555 - DNA, 465 bp, Homo sapiens
  Genbank Accession No. N53031
  unsure (1)..(465): n = a or c or g or t
acaatttaattatttattagtttcctcaacaacagttaaaacaacacaatcctgcatgaaatggatccaaagtatgctgagtatttgcaaaacagtactgatactgtcagtggacttcttaatgttcttgtttccatgtacaatcgtgtgacatgtagttaagcttagtaaattgtttttcatgtaacctgtgaattggaacaataaatttcaatataagctcaatacatttcaatataacctcatatggctttatatcatttttgttttccctaatgttttcctccttgacatgaaatatttctaatnggttaaacaggtactaaaacaaattttggacttgacaaggtaagttttgaaagatgttttgtcacaagaagaaaggnatctcttgggatcacaaacgtcttcctggttggaataaacnaaaggagttccctttattggggttcccagcttccagcc

SEQ ID NO: 2556 - DNA, 472 bp, Homo sapiens
  Genbank Accession No. N53067
caaaggacaaaagggtttcatacaacacagtatcaaaaagtaaaaggaacacactaaatgcacaagctggtggcaagtaagtccacagcctattgtgataggtccatccagcatcaatcagatttcttctcatctgttatctcaaggttatttacagatgtgttgactaacaagagtctctcatgggaggatgggcaggcttcaatcattggtttcgggatctgtctgcgccatgtaggcatccaactcagcatccaggtgtccttttgttttcgacatatatgcatccaattggttgtccagctgctccttgggtcaatacagggcgagcaagggcacctctccctcgtccacggcctcggcctcgggctccaaagccccctcttccccgacctatcataccccgacctctaccacccgattccggcacgacccatagctccaaggcctagggcccctcttccaggacctg

SEQ ID NO: 2557 - DNA, 485 bp, Homo sapiens
  Genbank Accession No. N53352
  unsure (1)..(485): n = a or c or g or t
gcttgaactctggtcggtatgagctccttaaaagcaggtactgggctggctgtggtgactcatgcctgtaatcccagcactttgggaggctgaggtgggaggattgcttgagtccaggagtttgagaccagcctgggcaacatggcgagaccctgtttctacaaaaagaaaaaggaaaaaaaaaagcagggactgtcattctcatctcctccctggggtatccacaggaatggacattcaaatggttgtagcctggtggggtagaaggcagagaagactacccagccagtgaagtgcagaggatagacataggaaaacattccaggcatttggagacagctggaaagtatccatgcttgactttcatggatttagaagtcnttaactgaattattaaaattgccttttttttgtgctgtacaatgtctactgtactgtgggtcatttagatgagatgaaaaacttaaattaaatctggaagtggc

SEQ ID NO: 2558 - DNA, 438 bp, Homo sapiens
  Genbank Accession No. N53549
  unsure (1)..(438): n = a or c or g or t
atagatagaacttttatgatgtgttttatggtttacaaaccacttaaagctcaccatttcttttgattcttacaagaactttctttatggaaggaaacattatcctcttttcatctcctagataaaaaggtaaattatttagcatataaatgattttcccaaggctaattcggacgagacagtagagctgggatttggatctagttttctctgagtcaaattcctctgatctttcttgaaagtcactttcattttgtcccaacacatctgagcagacaccagtggtttcagaacacgtgccatgtcttcttactttccttgcccctttctttcttaacaatattacacctgaggaacagcgcagaggcggtnactgactgggggaaatgggtggatacccattctaaacttcagggctcagcttctcattggttgggg

SEQ ID NO: 2559 - DNA, 498 bp, Homo sapiens
  Genbank Accession No. N53757
  unsure (1)..(498): n = a or c or g or t
ttttttttttttttctgccaacaaatgtttattaaacacctatgtgcacagcnaggagccaggatcttcatctccactgcagttcatgcttctggagagctgtccaaaagctcgggttgggctggtttgaggcctgggatccagcccgaggtgaagatgggaggaccagcccagccccaagagctcccagccttcagactcctgggtggccttgactggcagcaacagccttaataagtattggagctggagaccaaacccaacaccattttccaggaggggctaatccatgaccaaggtgcttatgagagcatccttcctgggccttatgagagcatccttcctgggcccttctcttgccagaaaaggccgtggatggcagacctgcaggtgcgccctggagggaagtggctgccgaccggnctcccanagcgttggctcttggcctgagctttgcctctctctggnctcctgtgaaatcacacccagggtagtggn

SEQ ID NO: 2560 - DNA, 260 bp, Homo sapiens
  Genbank Accession No. N54053
acaggaaaaataaggcatttattacagattgaaactgatcagaagaaaaatcacagaattcacaaaatcattctttgttggaacttttcttccttccattgcattttgctgttaagagaaaaggagtgtgagggtcagaccaccgtggcatgcgttcacattccagctttggaggccagggacccaggactcctgggaattattcaaaaccagatccgatgataccagacactagagcagctatgaaagaagcagctcct

SEQ ID NO: 2561 - DNA, 226 bp, Homo sapiens
  Genbank Accession No. N54067
tttttttttttttttagaatctgaacagcaccagctgcattgcacccttgatttattttggagtaagaaaaaaaaaaagaatggggataaactggtatataagaggaacaggaaggaggggagagaacccaacacatgaggtctgcacacacagctgtcctggttgccctcggtgcagctccgagctccagttacaaggaattccaagttctcaggatcttgaaag

SEQ ID NO: 2562 - DNA, 360 bp, Homo sapiens
  Genbank Accession No. N54265
  unsure (1)..(360): n = a or c or g or t
taaactccaaagccaaggttttttattactggtcaaaaggtgctcgctaacaaaacagtgttggggagaggtacattccacagctctgtaggagccctagtgggncatcctgccccaacccgccccgcctctccantgggnanattntaaggnatttcacacattggngttttcactttttttttttatatatataaaaacaaaaccagtcctggagtagaaagaaagaccctgtgatgaacttttaggactaaactgaaatggaaaggattggagtgtgggattctgaggggctgggtcagtggccatggtggtccagccccccatggttggcagaagccgcttggaaaggggcatgag

SEQ ID NO: 2563 - DNA, 475 bp, Homo sapiens
  Genbank Accession No. N54311
  unsure (1)..(475): n = a or c or g or t
gattcaacaatacatttttaatatagctttaaaaaggcaaacgaattttaagatcaccaggggcaaatgcagagcataagacattcactggatccagttacgtgtgtaaatgccctttaccaagtcaatactattaaagagactagtggttcgtggcagaaattgtttctgcttataagggaggcaagcgaggttctagtgtcctcagcaaaggcacaaactcatagcataatgccaggccagtcatttaacttcccagagtctcattcccttcgctgacaaaataggaagattgaatcagttgatttctcatggattaactattttcatatccagtgaattttcagcttatcagctactcaattgccatctgcttttcttctctggtcttccatcacaatggcnaatgccctcccatgtgtatctcgtgattgggctggttgttccctcctaccactcctgggtgacatactca

SEQ ID NO: 2564 - DNA, 157 bp, Homo sapiens
  Genbank Accession No. N54395
  unsure (1)..(157): n = a or c or g or t
tttttttttccaagagccaagcagactttatttctgcagcaatctctgctggtcagggtgcctgcntcctctacccactgcccttcatggctgctgcagtggnccgcagctgtggccatgcagccacactgtcaaggttcagcgatgtngcagtcat

SEQ ID NO: 2565 - DNA, 476 bp, Homo sapiens
  Genbank Accession No. N54399
  unsure (1)..(476): n = a or c or g or t
aaatatttctattacttttgcccctactatattccatctaagaatacggtcacagaagaatgaaagtggagtgaaaggtaagaaagaaaagtgagatgataagaaagggaggaggaaagggaatggacaaaaattagatggtcttttatccaatttttagcacaggcacagaacaatgaggttggcatcactctaaactaatccacgttaactgactacaaagatgatangaaaatgaaattaatgcatcccataaaaatgcagttctaatagatgccaangatgggcattatccagaagcgctgtagaaggactctgctgtttctcagtaggtgggtcaccctttgccttcagaacacatgggtcttcttaagtgatatttccatatcagatggtgagatttgtggttttcccaaactcagtcctgaccataagaacaggtaggtgaaccttgttaaaatatngcagctcccagt

SEQ ID NO: 2566 - DNA, 506 bp, Homo sapiens
  Genbank Accession No. N54417
  unsure (1)..(506): n = a or c or g or t
ttttttttttaaagataaaaaaaaccttacataactttatttttcaaagactaatatgtctcaggtacatttagctacagtacaaaggataagaaaatagcgcctaggaattttttaggttgtagagaatctcaactggctttaccttttgtattttctctccacttctctagcaaagaagacagagtgctcccattcccacttcttcagcctattgggtcacaaggggcctaattttcatgcgaacagccctgagggaataatctgcccctctaaaggaaacccagaccactccattctcaatctcataaggactgttattccttgggtcataggagcccccagggtagtagattccattggngattggctgcttggcagttattataccaccagcctcccccatngacttctggaaagttctcttcccaatggtctggatccctgtcaaaggtgctgaactggcatggttgnttgtnagaggtgtactctggncccttcctctt

SEQ ID NO: 2567 - DNA, 511 bp, Homo sapiens
  Genbank Accession No. N54429
cggaggtgatggatatatttaatatcttgactgtgccagtgatatcatgggtgtatgcatatttccaaaatcatgaaatcgtatatgttaaacactttgtatgacagatgcatccgacagcattaactcaagcataccctgagaatgactgtatggtctaagaagaatatgtgttcagagtctaagctaaggaatccgggaatggccaacccagagagattcacttcttatctgtgaaggacacttgaactccctgcctgtccgttggaactcaggatgtgcaaggaaccaaggccttttattttgggttaaatggaggttgctaagtggagagtgctaagtagaaatgttatataaactacatactctttacaaatagtagcggtcctgtccagcccactgccactgggaccacatctgtatttaagtcctaaataaaccctatgtcccattcactgggctctgggtctcttcttggacaaggcgccatccctgttggaatcaatagggc

SEQ ID NO: 2568 - DNA, 497 bp, Homo sapiens
  Genbank Accession No. N54511
atgttgatgatgttttaatttctagaatattgtatgacatggaactattcagaattcctttaaaaaggaatctgtcttgattaataacattattaaggtactttcaggctttcccttaactccatcgagaaggaagagggagtatgtgagtacatgtgcatgtaatgggtcaggaggaacagaagcaaagaaggaagcacgtgggaaagtgagatgtccataaactgaaaaaccaatttacagaaaggcatctgatgtattttctaaataaggccttgatcagggtaaccaatcctctttgtagcacattctacactgcccataaataaaggagtctctttaaattaacatttccagtatcaatgaacagtccagaaatcctcatttcaagcgttcgatgagtccctggtgtgagtccaaggtgcagaagttgtgttcgggagaggtttgcaaggttagggaaggccgcaagcagcttctccccatgccagttccag

SEQ ID NO: 2569 - DNA, 274 bp, Homo sapiens
  Genbank Accession No. N54604
  unsure (1)..(274): n = a or c or g or t
tttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcanaaatnagggaagtnattattggtagatgttgcactagagcatagtttatgcagggaatgcaccccgagacccttctactgggtga

SEQ ID NO: 2570 - DNA, 488 bp, Homo sapiens
  Genbank Accession No. N54792
ttcatattttaaaataatcttttatttgctcaccatagacattctgacctacattacattgatatacattatatttatttgcagtgagaactgaataatttaccacacagtataaatcacaaaattataattcctgaatttctagcattattgttatgcatgtgagcggttaaccagaataatcaaacatcattgatgttaatctaagtgagaagttggtaataaacacttctaattatgaatctagaaatttcaggagacaaattccaccattgaattcttgtatcttcagaatcagacctagcatatataatcagaaaataaattttgaagttcaaatcagtggtgtgtgtgttagaaatgtcaacatgtaaaacagaatgctagttaacaatcacattttcctaagaaaaaatttgcatcttaatcatacgaatatcacgaaaacagaccatttccagttttcactgtagtcctggatggttttc

SEQ ID NO: 2571 - DNA, 320 bp, Homo sapiens
  Genbank Accession No. N54841
cacagtggcagattttctttaatagatatatttcaaacagatacaacaaattaaaaaatctaattcacggcaggtaaacatgggtgctcaaaaagttccacatagacatttacacttgggccatcagtatttccctcacattcccttttgttaagtcccatcttcgcagtggcagtacaggagaaatctccaccgtcaccgcacaatccaccaggcgcattaccacctgaagtgaaggtctcatctcgaaggtgcgctcagccataaaaagaaaacatattacagaaaggaaaaataagtgtgctcttcccacccgcaaa

SEQ ID NO: 2572 - DNA, 459 bp, Homo sapiens
  Genbank Accession No. N54950
  unsure (1)..(459): n = a or c or g or t
tttttttttttttttttttttttttggctctgaggaagatttatttgctctgaggctctgcatcccccagccatccccccagagcctctccctgtgggaacacaggacacaggcagagtcctccccanagcttgcatctgtcccctgaacagggcaacctggacgccaggctnggatggaggggagaaggcgatgcagccgcaatggtagtctccanggtgtntnaggagccggcacctgctctcacacgatgccatcaaagccctgcaggccanacttcttgccggccacctggaacccgaatctcagtgcttcctgcacgctcctcccctgggagaggctnaagatnacggaggcatttnaaggtgtctccagtcccagtgtatccancacgcggggtngcgggaaagcatccgagtggagcaatttgccatcanggnccaaggngttggggccttc

SEQ ID NO: 2573 - DNA, 431 bp, Homo sapiens
  Genbank Accession No. N55272
tccattttttaatcttcttcatttaactaaaacatacatacaatagtctacaaatcttaaatgtacagcttaatacattttacatatgtatatactcatgtaactaccacctagattaaatatatttccagtgcccctgcatctctttctggtcaatattactccaaaaataaccacttttctgacttctgttaccctagaatagttttgcctattcttgagcttcatgtaaatggagccatgtggagcccagactttttgactcaatataatatttttgagattcatgcatgttgttgcacatatcagtcatctgtccttctctattattgcttagtattccatgggtatgtatttactacaatgtcttaatccatttttctgttgataaacacttgagttatttccagttttgcaaaaagctgtttcct

SEQ ID NO: 2574 - DNA, 305 bp, Homo sapiens
  Genbank Accession No. N56935
ttaaaatggcttttattgagacacttgtagggattctgcaacatttccagttgggaatctttatttccaactcttagggtggctaaacccttttctgaatgccaaaaggacactctcaccaccttaatgaggaaacacacttatctgtgtctgttccgatatccaactgggacctggaccccaagccccgtggtgtcttgtacaagtctcattagtcctccacgtacaactcagaagcctgttaatcagggagggtaatttccaaataaatgtgagctggcctaaatccagctggttatttctga

SEQ ID NO: 2575 - DNA, 300 bp, Homo sapiens
  Genbank Accession No. N57464
  unsure (1)..(300): n = a or c or g or t
gaatcatctcccgctttcccgggactttgctttcactttcntcagtcttgtggacagagtcaagtagattttcaaaagtgctccagaaaggccggaatagtcatgtagtggatgaaaagggcagtcacaaaactgcttaagaccagctgtcttgccagtaattgcagtgctttaagatttaattaaaaagccgcctgcctttaacccaagaacacttggtattagggcaccatgtcttggtcacggctgctacgtgtatctgatgtaagttnaccatggnctgtcatnattatnttgctg

SEQ ID NO: 2576 - DNA, 388 bp, Homo sapiens
  Genbank Accession No. N57934
  unsure (1)..(388): n = a or c or g or t
ttcggtgccaaaactttactggaggtcacatgggactaggggccttctgtccctgccagcgcctccattcccaggcgatgccccgctgcctgcccacctatcctccgggccccacacgaacaagctgtgtccccaccgaggtcacagctcttccctctggggatgggcganggaaggggcaaanaagcccggaagaaggcctcccggaaccgtcaactcctggccgggtctccaagcaagtccaanaacaagtggaagcctggggtcttggntttcctgnaagaaggctgggaaacaacgaatggttgattctggtncttaaaatggctccgtcttgtgaatgttccntcaaggtttaatgancacgtttgaaaatattggggccaaa

SEQ ID NO: 2577 - DNA, 512 bp, Homo sapiens
  Genbank Accession No. N58009
  unsure (1)..(512): n = a or c or g or t
ttttttttggtgccaaaactttactggaggtcacatgggactaggggccttctgtccctgccagcgcctccattcccaggcgatgcccgctgcctgcccacctaccctccggccccacatgaacaagctgtgtccccaccgaggtcacagctctgccctctggggatgggcgagggaggggccacagagccggagaggctcccgcaccgtcactcctgccgggtctccaagcagtccagcaccagtgcagcctgggtcttggcttcctgcaggaggctggtccttaaatgcctcgtctgtgatgtccctcaggttgatgaagcacgttgaaatatgcgccaaacacacccatntccagggctttggccgccacctggaggtctgaccggnaggccaggnttccaaaccgggcaagttcctgaagggccggcaaaaggaaggcaacggttttcgcaaagtttngggaacaagaaaattgccggcttaaaacctcctgtaggggccnccttgcc

SEQ ID NO: 2578 - DNA, 335 bp, Homo sapiens
  Genbank Accession No. N58326
ttcataaataagtattataactttattaaaatgaaaagacaatattcaaaataatgcaacaaaatgaataaaatcctttgtccaatactgtacacataatgcagaaatcagtgcatttttcttaagcatgttttaaccttcatttagttcatactaaaatataataagctttaaatagctcaaataatattcagcagtttaaactgtaaacagcttgtttaactgttaagagaacattgcagtaatgtacctctgttagtgagcaccttctcttctgtgcttatctcttcaagataaatacatggaaggatgtggaaatcgggaaccaccaacta

SEQ ID NO: 2579 - DNA, 299 bp, Homo sapiens
  Genbank Accession No. N58463
  unsure (1)..(299): n = a or c or g or t
gtcactttagactttttaatatttcatacagcgattatggtgcattcaggaacccaaccccccaaacccactaggagggctcccacccctgccctcccaccccatttcagggccccagggcttagggtggaggaaggggaggtaaccacccatccagggactgaccctggagactgtccctgccctgcctcaccctccccaggagatagggggcaacacctgggcacaacccctcacacccccctcccccaancctgcttgtgcacatatgcacattatgggtcctcgctgagctggtc

SEQ ID NO: 2580 - DNA, 377 bp, Homo sapiens
  Genbank Accession No. N59089
acaaaatttatttagaaagttacatatgcacatatggtaaaaagttcaaaaagtggcaccaaaagatataacagtgaaaataaggctggttcttgtttttatccactgaggcaaatactgagtttattttcaaaggtattctcgtgtgggcacaatcacgcttgcatatgttaaaaaatacaaaatggtatcatacttgttcctctgcactttcttttttttctttttaacaacatatcttagaggtagtcctatttcaatttagctagacccatttcattctgtttaatggctacatttcgtttttcattgtgagactgtgccataatttatttaatcagtgccatattgaaagacatttggatcgtttcccagca

SEQ ID NO: 2581 - DNA, 418 bp, Homo sapiens
  Genbank Accession No. N59231
tttttttttggcaggggaaagccagctttattgagtaaacttcccaggacctgggacatcttagatctccccttcccccaggagataggacccctaaacctcccctgggtcctaggacacctgacccaccacttgtagtctccagtgaggaggggacccttatttggcaagagatgaacatgtaagcagctgtccgccggagaaaggacgatggctgaaaggaatgaaccaccgcaagcggtgttctctcctgtccagctgtggacaggacctccacggcccggccttcctggcctcgggcacttggcttggcctgggctgccgtggcagcacagcttctgttgaaggcttggggatggccaggctgccggtctggggcaagatcactcgatttccaggatgaggtcgtcaccttcca

SEQ ID NO: 2582 - DNA, 463 bp, Homo sapiens
  Genbank Accession No. N59283
  unsure (1)..(463): n = a or c or g or t
cttttcatatttcaactttatttaaaatatgaggttttatgtccagaagggagggcagttgccatcggaaggtgaagtgaggcacaatactattgggttgcgggccaagtacacagggttgcactgtgaaggaactgaggaggttctgggagggcctggtgacaacaatggatttggggagatccacaaaggaaattttcatttcctccccaggttagctattcagtgggtggattattcagtctttttaagcaaggtcactgctccttagcaacatcaacaaaagtgccaaagctgaggacacagagaataccatcattgtcttttgtttctctttatgcctggatggggaaaggaatggaaactaatagcagaaaatgaaacatttcnggatgttatcccttgccatgaagaatcacgggcttgtgtagagacctctttcctttcntttttttttttgagg

SEQ ID NO: 2583 - DNA, 396 bp, Homo sapiens
  Genbank Accession No. N59474
  unsure (1)..(396): n = a or c or g or t
gaaaatgagtacattttattgtatataaatgacacctcaataaaaacgaaagatgtgagcaacatcctgggaaaagaaaatgtgatttcaccttaagtgctttanagaattctattatatgcctcagctcttactctttcttcttttttgagacagagtctcgctctgtcacccaggctggagtgcagtggccacaatcacagctcactgcagcctcgacctcccaggctctaagaatcctcccaccttagcctcctgagtagctgagattacaggcatgagcactgtgcccaggaacttactcttgcctgtaaaaatacagctctgaagtgaagaaatcccaggngccacatcaaggaggcgaaactagagtccgcagaggccagccccgcacga

SEQ ID NO: 2584 - DNA, 445 bp, Homo sapiens
  Genbank Accession No. N59532
ggcaagtaagaaggaagtttaatttttttttcaggattcagtggagtccattaatgcataccaggggcaaagatcagcccagggtaaggcaagtctgggaggaagcccaccctgccctacagcagccctggaactcagaataggtggtgagtctgccatggtttgctactgggcagcacactagaccaacttgggaatgtggaagagtgagtctatgttccctcagccatccccaagtttacacacaggcatagcagccctactgtgagtcagcaatcattcctgacttgcagtaaggacaatttgcatttacggaaagcaaactggagggggtagcctaagtccgcactgcccatgttattaccctttgcaatgtgaaaaaccatggtgaggtaggttgggcaggttttatcctctccacaaaggtgagcctttgctccacagc

SEQ ID NO: 2585 - DNA, 438 bp, Homo sapiens
  Genbank Accession No. N59536
cattgctaaggaagaactccctctgctcttggaagattttctactctactgatcttattttattttattttatttttacctgatgattgtcttaggcaccctccttacataataaaccatcaagctaacttgaacagggaaactgagtcacactcaaacaatagctaaggtcaaaagtgtagtgaaagtagaaaaagtggggaagggataggtctaagtgagtgacagatgggctgattcagacagggcaataagcacagggagatatgaagacaactaccaaagcaagtggaagacaaggttttcaactttattgtattgaaaaatacttgtcacttggttcagatggcaaatctaaaatgagcccacaatgattatgtaataaatgcagaacgtaccacaacaaatcgagactaacacagaaacagaagatgtgac

SEQ ID NO: 2586 - DNA, 428 bp, Homo sapiens
  Genbank Accession No. N59543
  unsure (1)..(428): n = a or c or g or t
aatggtatttattctagcaaccacaacattgttacaaaagcacaattttaataggcttatctgctaagatgcttttataagcagctgtcacctatacagagttatgaatcatctttggtgctcaaggaacctgtagaagtaagagacatcatcatacagagaaatgtagttaagttaagttgaagcttggaaaagatcacatgaaaaaaatctagctcttgccttatctcttcctaagttaagcataaattagccgtctgcaatagccgcctgtaagacaaatgataacagaagacaatcacacatggtgaatcggtttccagtggagtttttcttctaaagagacagtaaacaggtcacaactcattccttgagaaaggattcctattaaatacccagaaacagctatcaaataaacagccaaagcn

SEQ ID NO: 2587 - DNA, 434 bp, Homo sapiens
  Genbank Accession No. N59550
gctctttgagaaagtttattggcaccaggaagggtgttgggagctggcaactacaactggtgagcaaccgggcaggcaaaattattcctagagcttcagcaagttctctcagcagttatggacaaagctggtcccagcttacagcacgcagtttcaccagctggatgtgcagagaattacattactagattaatgttatgtgcctgaggtgcttttatccctggcttcttgacttttgattgggtgtgataagaatgacttaatttggtgtaatccactttcacagcactgagcatacttagtatgtactgagggttgctcgaattaacggtgtgtaccgcaccccaggaaggcttaatgaagtaggattactgcttaagctaagacctttattaaaattttgtcctctggccagtcgtggtggctcatgccta

SEQ ID NO: 2588 - DNA, 413 bp, Homo sapiens
  Genbank Accession No. N62126
  unsure (1)..(413): n = a or c or g or t
aagagttgcatattttactttatttttattaaattaaaagctacagtctggcagcgattccagaacagggtaaggaggttcctcacaggggtcagagaagagcggagaaagacagactgacggagactgagacacaggagagaaaggacaaggttaagggagaactgtatctgatgaacacacacagccggctccatggcgggtgacggggagctcacatcagcccaatttctcctccccggcacccgaagttcagcggtggagcagtatgtgggggcggttaggaatcaagagaccctcccttccccaccctaggtccttntctcggcttggtcgtggagcacagcacattaccagaaaaagncaagggcaattgangggcagggaaaccgggagnatattntacacgggga

SEQ ID NO: 2589 - DNA, 453 bp, Homo sapiens
  Genbank Accession No. N62443
ttcccactaaataagaaaactttaataagatgattacaaagaaattaataaagaaatagaaaatgatagcagcttcaaaaataccagtctccctgttttaaaacaaaatcaataaaatcagtgaatcacaattcattgaactcattcttggctacaaggaagcagctggatagatccactggcaggcagccctgcaggattaaaatgaggcccactgccaaaaagccccaaatgagatgccgtcctcctcatcctcacaccatcctcatcaggcagggaaggaataggattagactccctattatcggagaataggttgaggcacagagcaggaagggccccttcttaatatcatagagcccctctgttgggtcagaccagaactgggggcagaggctaaaggtgagacccactgctgtccaggagcaagggggctggggggtaggggctacc

SEQ ID NO: 2590 - DNA, 396 bp, Homo sapiens
  Genbank Accession No. N62487
  unsure (1)..(396): n = a or c or g or t
agacatattttcatttctttattagaaagaggtctctacaccatagccacctctctctgttactttacacatctttctttttctttttcccttagaatactgtacagcggacacaaaaaaatcccaaggcaggaaaatacaaactggcatatttaatcaaaacaagatcatatgaaataacaagcaaagtgaaatgtctgtcaatggttttaattacagtacaaacaatataaataaagcatcattgagtcattgtgaaacataaagttgctgaatgaggtaatagaaaacatccaaaaaaaaaacctaaacccatctgtggatacacccacgctgcccttccatctctatacactngctatttacagaaacagaaaactggctggcaaggtgggt

SEQ ID NO: 2591 - DNA, 413 bp, Homo sapiens
  Genbank Accession No. N62523
tgaaaggaaaaaattcaaagtttattcaacattaagaataacagacagataaaggtttggacttaacagcataaataccaccaatatcatggtgtacaattaaactaacctcatgtcaacttgtacctgtttaacagatgcgatctttgtggtgttgccaaaaggataatggattattgttatgtttggtaaggtgctcaaaattaaagactttatgtcgacttattcacacacatacacacacacacacatgcacgcacacacacacacacacactcttacacttagcctcctgcaaaatgtattgactttagttgctatatccgattcggataaaggctttgctcattttttaaatgacattattaattgcagaaaaaacgtggaggagaccttggccttggcaggtgggg

SEQ ID NO: 2592 - DNA, 414 bp, Homo sapiens
  Genbank Accession No. N62652
aaaaagatacactttatttatttttctaaccaggaaagaatcatgatatttgctgggtttactgattaaaaactaccaccaccaaaacagaacaaagaccaaaaaaaaaaaaaaatgaaggagggatgggtatcatcaaaagaaattctgtctcaattacagggaaaaatatttagtttgttcaccagtcaaattcaagtcacagacaggcagcttatacacatttaaagacaaacaaaggtttagggcaggacgagcaacaagcagagtgtaaaaagaggcggggagggagctggagagggcagctggggaataacgtgggtgaggacaggtggagtccatagcccacacgttgaaatgctgcaaagggcgcaggcaggcgattataccccttacagatttccgtttttgtaa

SEQ ID NO: 2593 - DNA, 437 bp, Homo sapiens
  Genbank Accession No. N62675
  unsure (1)..(437): n = a or c or g or t
catatagtcagttaaactttattatttacaagttaaattacacagcagctttacacagcatgagatggaaaggaaggaaggagagaaacgaggagaggaagctggctcctgagattcttggctgcctccacctccttctcttgggcgtacagtcttcagtgctgcctccactccaaggtcaaggatcagggcttggaacacaggtttaagtcaggttctggctctgacagccccagggccaccagggctcccactagcagcttcttcacaggcgttggaggtgagtgtgaaggcatcagctgcagggagaaaggttaatgccagttngggggaggcacacaaatgttctacccttttaaccccacccagccctaccctaagggactccaatttatctaagacgatgggcgacaaatganggccacntggaatttcaa

SEQ ID NO: 2594 - DNA, 242 bp, Homo sapiens
  Genbank Accession No. N62819
ggtgctggttaggttttattttaacaggatgttttctcttatttttcaaaatatcagttatatcaatattagaagtgtaaacaggtacaaaatatacagtacatagaaacaattttcttaactagtctatcgcctaataaaagtatgcatgagggggctgaatgaatgggcactgccaggtccctccgtctgcaggggaaacaagaggaccagtggctgcttcaacaaaacaggaatggata

SEQ ID NO: 2595 - DNA, 497 bp, Homo sapiens
  Genbank Accession No. N62922
  unsure (1)..(497): n = a or c or g or t
agatttttagaaattcatttatttgcaaattacagtgaaaaatttctcttccagatgcatataaatccgaagtttttatcctagtgaagcgtacagaatgctattgttatgacatttaagtatcataacataatgtagctaataaagctttttaaaaattatggtaaagtgtatgtgaaatttaccattagtgacattgagtaccttcaccatgttgtgcaatcatccccaataagtagttccagaacattttcatcaccctagaaggaaactcctttttagcaatctctccccactcctttctctcagcttcttacaaccatttatctgctttctgtctccatggatttgcctattttggatatttcatataaatgcactcatgcaatacgttgccttttgtgtctgccttctttcacttgggcaaaaatgcgctcaagggctcatccatggctttagcangtaatcagtccctcatttcnctttatgggctgaat

SEQ ID NO: 2596 - DNA, 419 bp, Homo sapiens
  Genbank Accession No. N63047
  unsure (1)..(419): n = a or c or g or t
nttattttaaataaatattttaattctattgttgacatttacaagtagaaagcatacagtatgttacaaatatcaaaatgagaaaaatatgaatgttacataagtaacaaatataaaaaaagtattttcttaccttccctgaaagtaagaaaactattcagcataggaaaatatcagtatcaaaaacacagcttaggtgtaaaaaaagtttttacacagtatttaaaaaaaatgatctacaaaatgacaaagtaagtgttgaaatctgatttcatataaattataaaaactgggtacttagagtaaatgttatctggttggaaaataagtccaatcataagctttccttaggtcaattctttaaaatattaaaagcataccgaaaaattttccaataaataaccttnaagaggggttcc

SEQ ID NO: 2597 - DNA, 313 bp, Homo sapiens
  Genbank Accession No. N63165
tcccgagaaaaaccaatttaatgcttctgttctcagcatttcacagcatgcaggactcaaatggatacaacagaagaaaaaaacccacaatttttggaaaagcctttgtccaatgattaatattttgatatctattgacaatcccttagaactttaaatctcaaaaacaaaaaagtactgtggatctccatagtttatacagaattatgtgaattctataaacttttctgaacaaaacaattacatgtcaagaatccatgaagcctggaagatacgctcacgtttttgaggtttgtattaatgccagttttta

SEQ ID NO: 2598 - DNA, 472 bp, Homo sapiens
  Genbank Accession No. N63172
gttgttttaaaactttattattatttgtttaaaagcaaggcatgcttatggatgactctgtaacaaactaattggaattgttgaagctgttccctggttccaccctggagagtaatctgggacatcttggtgtgttgttgttgttgttgtttttcctcctctttttttgaggggagtgtgcagtttgtttttcagtcttgtttttttaattcattaaccagtagatagcccttaaggggaggaggaaggatccacttcctagatctagtttagaaaacatgttccccatctggtgctctcaggaaggagtatagtaaatgcctcatttaataacatactcctttttgaaagttgccttttctttccacccttggagtagatccagtatttggatgaaactccatgaaagtggggtgaagcctgtccttgcccctcctgttttctagggccacactggtatggtgactgtgga

SEQ ID NO: 2599 - DNA, 268 bp, Homo sapiens
  Genbank Accession No. N63391
  unsure (1)..(268): n = a or c or g or t
attggaatattttatttacattttatatttaaagagaatcaatacaaattgggacatatttacagcatttcaaatcagtgtacaagaatgcaatggtttcatccattcagcaaacaaaaatacatgtctgttttatttttgcctaaattctgctataatttgaacaaaattctaaaacaaaagccacacagagtacaaataaagtgcatttttaaatagctctatttaactttggnggatgaaacttcaaactntatattaaggggcc

SEQ ID NO: 2600 - DNA, 204 bp, Homo sapiens
  Genbank Accession No. N63604
taattaataaagagtccaccttttaatattcgtgtttaacacatctatgggtttggtagaaagcaaattcatgaccttgaaatagtagtaggtgataacatgtgacttgccagtaaattctcatatcttcactgtcacttaggagataatcgaagaatatgaacatatttaattcctaaagttcctgcaataacctacatacac

SEQ ID NO: 2601 - DNA, 427 bp, Homo sapiens
  Genbank Accession No. N63646
  unsure (1)..(427): n = a or c or g or t
tgggattttaaaatcattttattaatccaacagtacaaaagacccccaccaccaccgcattctgccatcactttgttccaaaaagtagtggagtgagagagcgagagggagcagatccagcaaaaacactcccccaggggccattttacaaaatgcggaaggcgcgaagacaacacaaaaacagcaacagataaatggggcaaacagaacaacaaacacaagagttgagcagcggggtgggggtggggggttgccatctacgccgttttagtgtgagggacactgggaacgatgcccagaggctggctctcctcccagcctcaaaggttgtcagctccaccagagcagggtcttctctcctcatgccaggaactgagagaagtgggggtaggggaccactaggtcttttgccacngtatcttgagct

SEQ ID NO: 2602 - DNA, 497 bp, Homo sapiens
  Genbank Accession No. N63688
  unsure (1)..(497): n = a or c or g or t
cgtagagatgggtcttgccacgttgcccaggctgctctcgagctactgggctcaagtgatccacccaccttagcctcccaaaatgctgggattacaggcgtgacaccnatgcccggcaataatggatctgagggaagatactaaatatgggcagagactgaatacctataataaagatcatcaagctacctaaatttggcctactttgcagaatgattaaaaagtggggcactagcagcaattgcagtaataaaaaaccatacaaaactcaaaaaaaaaaaaaggctataagggctaggtgcagtggctaacgcttgtaatcccagcactttgggaggctnaggcaggaggatcacttgaggccaggagttttgagaccagcctgggcaacacaagacctcacttgtttctactaaaaaaccaaaaaatttagccaggtatggtagggtgcacctgtagtgtgagatactcaggggcgattacctgagnccaggaga

SEQ ID NO: 2603 - DNA, 492 bp, Homo sapiens
  Genbank Accession No. N63698
aaaattgctaaaaacgaggaagatctcagttatccttcaactggcaaatgaataaacaaactggtacagccatgcaattgaatactgctcagcaataaaaaagaatgcactgccagtacagcaacatggataattctcaaatcgcattatgccagttgacagaggtcagactcaaaatactatgtacagtgtgattctacttatatgacactgaaaaaagcagtactataaggacagaaaacaggttagtggttgccaaggagtgggagaagcagccagggagaactttgaggaggtaaaaatgtgccaggccttggtcggtggtggtacataactgtgcatttgtcaagactcagtgctatacgctgaaaagggcaggttttactataagttgtacctcaataaacatgatttttaaatgattaaaactttggtttttgtttgttttggttcagttttaaggtttaccataaatctattgggttttagatt

SEQ ID NO: 2604 - DNA, 413 bp, Homo sapiens
  Genbank Accession No. N63845
ccgagcaggaatatccactttatttggactccatgacaccgttcctatgcccttgactagatgtgaatgtattatacattgttctagatttgggggaaaaaaatctcttatgacataaaattggtagggaatgggtttatcagaaaggggatacaaaacataccctaagctccaaatcattcacttcttcttgggtaaagagctaactgaatgaaagaaattgatttaacacttaaattagacaccaaccacctttattggctgccaccctaaattagttttccttaaaacagtaatatttcacttttactgtttttttttccattaaagcaacaccattgtgctgcaaaactaactctatgcaattaagtacctggatacatgttttctggcttttaacaagtgatagaaaa

SEQ ID NO: 2605 - DNA, 463 bp, Homo sapiens
  Genbank Accession No. N64017
  unsure (1)..(463): n = a or c or g or t
cgttgtaattatttattctgttactggctgcttagtgtgacatatttgatgttatttcaattgtaatactcttcaaattggaacactccttttctgatattcttagcaaatccctcttttatttttgccacttgttataatatctctaagaagttactccaggaccgggcagtagggattactgattcagatgggtccagtgactagaatatgagtagaaagtgtgaggtctaatttgaacctgtcagagttactgttgcctgcgctggcccaaagtgcagatttttagtcagcttgtgataggccaggtgttttgtctggaccaggagttatctttgacttgtagctagaataaggatcctgagaagtcaggtatccacttgatgtccttttatttgacttgttaccattagtactctcctgggatcaaggctgccaaccgaacctatancccagatttccc

SEQ ID NO: 2606 - DNA, 565 bp, Homo sapiens
  Genbank Accession No. N64036
  unsure (1)..(565): n = a or c or g or t
ctaatgattatttattttgctttgtatttcagaacaatcttactttggatttttgatttaatttcactgaaattcagtcagcattacctgatgctagcatgtgaggcataatctggaagactgaatcacaatttactgctaggggagcctgccaagctttgccattctttcaggggagggtttccctgagaagccagtttttttagatagtcacttggctccagttggggaatatcagggttctgcctgtaatatttctgcaatttctctagaactgtgggcaacccaactgtggaagcatagaacatgggcccgcccttgtgccttggccatccatatccatgtaaatagacaacatcaatgtgctctgggctagcagctatcccttctcccaagatacggaatgcttcattgataagtgaatataagcagcgttcaaggatctcatcctggctaatgggtacgtggttcaatgtgangggttttctaacccgtgataggaattggnaagccanggatcaggttgcncgtgccgaattcttggcncgaaggcaaaattccctat

SEQ ID NO: 2607 - DNA, 430 bp, Homo sapiens
  Genbank Accession No. N64374
cagttcattgcaatttatttaatttaaaaataaaaacagaaacaaaaaccaaaatgaaacaaaaatcagtttccaacgaaaatacaaacactttgggtggttatccagcttgtttttcccctgtaggctgttctgggctcaaaccaatcaaatgagtgaaaaccaattttgacaggagccataaagcatgttgcaccaattaaattacaccaatatattattataatacctttgaaatgcctttcagaccaataaataaaaaagacaaattcaaataaaaaagtcaactttttattaccaaaaaaaatagaaattaaataaaagtcacaatgtggatttttttttttttttaatgtgcagtcaagtttctctctttttttcttctaggaatgataccatgccagtaaatccctacagaacatttccagtt

SEQ ID NO: 2608 - DNA, 453 bp, Homo sapiens
  Genbank Accession No. N64436
gtcaaatctcatctctgttctcctagttttcacagaaatatttacaggaataaaggttgaaacaaaagtacctaatgatcatctccatccatcgaaagattgctcagggataagacactcaaacaagggcttgtgatgaggatggaaaagacaaagcaacttgaagagaaaaaaaaattcttttaaactcagttcatcctgcaaaatggacataacacatgcatataaaggtttgactttttaattccacttttttgcctgatcgcagggaagatggcatgtggctggccttcctgaagccttgctcctccaccactggctaacagacaggcctccaggtggccttgcaaggccgacagtgaccgcagcccattccccacatccttaatcagagcctcatgcagttcatccccacattaccccaacataacgtcgtagtgctacacgtagatg

SEQ ID NO: 2609 - DNA, 421 bp, Homo sapiens
  Genbank Accession No. N64535
aagtgcaataaacttttattctttcttgattagatggagttacaattgccaaaataaaaatccaaggtccaattctggttttaaaactagaaaaggaaaaaatgttattatcagtaatgactttgggaagaattctttaacacacagtgagggtgagttcttttggaaacaactgtattctatgtttatacatatttatatataaaaggtgtcctcattgggggaggggggtgctgatgccaccaagttcctttgaagccttttctcccccactgccaatgcccgaggggaaggagtcttcaatggcggctcaatctagctcttgcgtttagacttggatctccattccaatttagggcttttctttctcttcttcccaaacttttctgtggtatcccagaatataggttggttcagaacc

SEQ ID NO: 2610 - DNA, 437 bp, Homo sapiens
  Genbank Accession No. N64616
  unsure (1)..(437): n = a or c or g or t
acattattaattatagagtttatttggacacaaagcatgagaatagccacctggaaacctcaactccaaatgaatggggtcagcgttcccaagtagagacattaacgtttcacacacacaaggaaatacagagaagctttcccagaaccaccacattttccattcaagtccagtgcataggctgcggcanttcgactggtgatggagtgatacacttcaaggaaggttacattatcactccataagaagggacaatgatgccaggaggtcttatctctggggctgcttagttttcctaattatttacaccgaaaactttttaaaattgatattaggaaactaaattgtatagcacattttgttttggttttggttttgttttggggaaggcgtcctgctccggtcgcccaggctggaaatgcagtgaatgtgatccc

SEQ ID NO: 2611 - DNA, 435 bp, Homo sapiens
  Genbank Accession No. N65959
ttgcagtttacttgattttatttaaaagcaaaatacattttaaaactctgtcattaattattactcagactcggaaggcctttctaatggtgtcctcaagtggtctccaattcaattaggtcaaattgagcccctgattaatgacaggctttatattagtttctaatccttataccaggaaaacctgatcaactacttcacatacccagcagtctttaaagaaacaagagaaaaatctccaaactcactggttggcaacctgtcccaccagggacgttccatcttgtaggtccctacgtttgtcaagccaagtgtgtaaggactgcatccatggtaggctcctctgaaagaaatggatgtctatgttgtttgagtgcgccctggccatcagcatggccagcttcattgggcttctgagcactgttcaccaagaaa

SEQ ID NO: 2612 - DNA, 417 bp, Homo sapiens
  Genbank Accession No. N66066
ttccagttaatttagtcctttatttttttcattctccatagaatattggttttgtaacaacgaatacaatccaatatataacattaaaacaatccgatacataccattctgctttatgaaagatcagcaaaaatacataaacaaggatataactagtacatttataaaatacatcataacaatgaaaccaaaggatcccacacaataatcttcacatttgacatgctggttacagctgaggagagccagtgtctttggcaagtgattcatatacataagcgatgacactgactaatcctaacacttctgaaatgttcattctttaccagttaaacctaaaataaatcagcaagagtactgaaatataacaagaatgaaatccaaaatttgtcgaaaggggcaatgtttaatactagg

SEQ ID NO: 2613 - DNA, 393 bp, Homo sapiens
  Genbank Accession No. N66130
gggaattcacattttaatgtttcagtagcctgaacaactcaaattgatgtgtacccccacctcccctgatcaggtcgcctccctcacccatgttaaaataaaaacacagtatgtgacacaggagtcccttgatgtttcttgaggagatctgtacacttgagtagcaaatacatatctggttgtcttcaatatattttaaaaagaaagaaagagaaagaagaaaggaaagaaggaaaaaaggaaggaaaagaagtaatattgtgacctttcttgctctttaaaaaaatccctgtctccttcttttcaggatgatgaagccccactagacattacaaacaactgcaacaaatgagtttggcaagcataaataaatggtctagttattcaaatctt

SEQ ID NO: 2614 - DNA, 301 bp, Homo sapiens
  Genbank Accession No. N66139
  unsure (1)..(301): n = a or c or g or t
caccaatgaacatttattgagtgtccacatgtgcacagctttgaacttggcgatcacagaacgcactgggggagggaagcaagggatcaagagtgtgtgtgtntgtgtgtgtgtgtggtccccctgggtttataagaaaggtagtccctgctggagccgccagtcgcgtctctgcagagaggagtcatagcaggggtgggagttaaagccaggcaccacggtggcagtggagtgtaatcactggggaaacatgcggattctggggaagtgtccctcctgttcctggctccagcaggcccag

SEQ ID NO: 2615 - DNA, 164 bp, Homo sapiens
  Genbank Accession No. N66422
ttttaatcatcagccatcatgtttaatgttccatcttatacatgacactttgtgcaggcaaacagcaggcttagaatgagttcatcagcttctgttaaaagatccgtttaatcactccacatagtgtaacaatctttcccctccagaaatttcgtaaccctaag

SEQ ID NO: 2616 - DNA, 388 bp, Homo sapiens
  Genbank Accession No. N66613
tttaaagtatccaggcaattttactcatagttctgtttagttccagatagcaacagctgattgttcaaagtgcagggtttttggatattcaagtaccacaggatcggagaaaaggagtacttgaaacctagagttgcgttttcacttgagaagacacactttggaaacacctatccaacagactacaaatataggctattaaattaaaaatctggtttcaaaataatacccacttaggttggaaatatctttctccaaactcagatccaacttttgaattgtttggtatcaaaggcaaagttaagagggacttgggtttaaaaactaaaattaccaagtgagtgcttaaaaaaaaaaccactccaaacatccttttttatccaataag

SEQ ID NO: 2617 - DNA, 422 bp, Homo sapiens
  Genbank Accession No. N66624
  unsure (1)..(422): n = a or c or g or t
atacagtggctcaaatattttattataaagaaaaatggaaactaaatcttcagttttctccaaaagtacacaggaggcatatattcctttacttctctcattaaagcaccatccgttcaattcattttgcaataccaaccccaaatttcagaacttttaaaaggtaaattttagcaaaagttattaatgaaaataactgaggcaacatcaaaatttaatagctccccaaattgactaatttatgttttagtaggaataaatcatagtacataataatagaagatttaataagttaaaaatatgaagggnggaaaaacccaaccnaaaaaaaaaacccaaccccttaaatctggccatggtccncaaacnaattttaggaaagggggaaaaaacctgtgtgcagggtaagncatttccttttt

SEQ ID NO: 2618 - DNA, 160 bp, Homo sapiens
  Genbank Accession No. N66763
ttttttttaattttctccccaaaatagccacattcttttatttgatgattcaatacatttttgattcaaatagtcaccacataacctaggcacgatattaagcattttacaagcaaaatattttactgattttcttttaaattgccagagtacagaagta

SEQ ID NO: 2619 - DNA, 426 bp, Homo sapiens
  Genbank Accession No. N66857
  unsure (1)..(426): n = a or c or g or t
cggtagagacagggtcttgctatgttgcccaggctagtctcaaactcctgggctcaagcagttcttgcctcagcctcccaaattgctgggattacaggcatgagccaccatgactggcctaaaacaaaataaattcttaatggcatttcgtggaatgtgtttaagagccaaaactgtgaaaatgtaagctttatctttcttttttcctagattatttaaagaggattgtagccacacttcagatgaatgtttacaagccaaataatgatttaagagtgtgctcaataaaaaggccataggtttaagaattaaatggaataatataaattactaggtcaacaagaatatttcatgtatagtacactgtctaaggaatgcagagaaattttacaagaaacccccagactaaatacttcnttaagaaca

SEQ ID NO: 2620 - DNA, 421 bp, Homo sapiens
  Genbank Accession No. N66951
gagttttatttaatgtcgggagcagattgggtaataaaatgtattttgagaataagactgccttttgaccttttagggtctagggctgtaaagtgtctcagggttgctgccaaacaagtcatgaactgggctggatttttatatttgatgaaaaagagcctaaatgctatctgatttcggataaagaaaaaggagcattaaccttgactatgcctttagctccagccacctttttaagagtaaattgctgggcaggagggggagggctagtcacggaacgaaactgtaagccggaccaggtgtgaggaggggaggcgataaaaagattatagggtggaggagcagaggctgaggaagaattgggacctagctcggcctggcgagaagcagcctgggaggaagggagaggtcagatgggtct

SEQ ID NO: 2621 - DNA, 447 bp, Homo sapiens
  Genbank Accession No. N67009
atcaatcatatttctgtcatctccaacctaagatattttttagattgtctccctattctttgattcaaaagccaattacagaaactatgaacttgacctaattctggtttttgacaattatgagacagaaataaagaaatcgcaagcagttcttttctttgcacactgaccattttttaattacatcatcctctatgatgatggtgctttcacaactgcagctctcctgtatgtcaaaatcattctggtttccaggtaaatggacaaaggagatttgccttcagtgtctagaaggcaatttacttttcagctgccttaattacctatagtttaaagaaaggaatgccacatatagggtcctttaaacatctaaaatggggaggttggcctccaaggggcaccattcccaaacatttgatttcaagtcccagaagcctttcatatatg

SEQ ID NO: 2622 - DNA, 330 bp, Homo sapiens
  Genbank Accession No. N67096
ttttttttttttttttttttttcatcaatttgaagcgcttgtgtttaatcttgctacccaatcctggactatatcgtaggtgcaatgaaactggggagacaggagacccggcttcactttcctcatcagtgaataggctgaatctcccaggggcagtctgttgggggcacggttggggtcttggtcaggatgcagggaagatcggggagaacgctgggtccaaactctgctacctgggaggctgagatctcaaccccacacccaccgccttccatgggcttctcaagcaacttgagactgctcttggtcatccgggttttggttgactac

SEQ ID NO: 2623 - DNA, 494 bp, Homo sapiens
  Genbank Accession No. N67105
  unsure (1)..(494): n = a or c or g or t
gaggaaatacaatagttttttcaatatagtaccacaagccattttttctgtaaaggaccaaatattagatactatcacaaaacattttatcactcattcaaaacaagaatcattcagttgccccaggaaaaaacacactgaaattattttagatagcataataagctagaggatatagaacatttgaaaaacagttccaaaaaatggaatactaaagatgcaacattaattcttagtacatttgttatggtaatgaattaaagcattatagaatatattcaagtcagaaatcctgtagtatgaagacataccttcatatgtgaaaatattattttatattaataataattattctggtatttatatcagatttatcatcagattttctttcctggaatttattaataatttggaccatgggaacacaaaaatattncattcattttataatacnttggttttaattattatttagaacataaatccatggtaaa

SEQ ID NO: 2624 - DNA, 418 bp, Homo sapiens
  Genbank Accession No. N67205
aattttaattcaaatttttatttaatcaaaagtcaaaatgtgaatacttgattagtggaattattgaattggtaaaacatacaatcaaaagtgaattcttagaactattattatgtcttaatccaatcccactgagctatatcttgatttcatatttttatcatgtctatagcttgtatcttaattgatataactcaaaagtaccatatagacatctcaaactaaagatcaccaggtgcttagtttcagagctgggttgtctgctatggaaaatatttcccagaatttagatgagattgggaaagatattgcccagaagagttcctccaaaatgccctttatatagagctcaggagaatctggaataatactgggctagatactgccctaaggccttgtacacttaaactaccacgat

SEQ ID NO: 2625 - DNA, 233 bp, Homo sapiens
  Genbank Accession No. N67378
tttcagtgttacaaaaccttgtattaatcatttcccttcactttcaatataacgttgatatgaaatatagccatgattcttagttacatgggaggaaatgaataataaatacattgtagcaagtttaaaccacaagggtgtttcactgggtaacaacatttgaaaactgtacacttgcaaagaacagcatcttcaaacattagtatatctgtatatcagtaaagcttttacat

SEQ ID NO: 2626 - DNA, 334 bp, Homo sapiens
  Genbank Accession No. N67815
  unsure (1)..(334): n = a or c or g or t
tttttttttttggtaaagacttttaagagaaagaagtattttaaaaagtagcagtgctctgaggctcagggtgtaggatcgggggcacagctggtcccgggaggccccttgtgcacaggtggtggcccagggcnangtgctcgctcttgggggacgcgcggccgggggacngccatcgtntccggcccggggctcccggcgggctccggcggcagggacaatggcgaggccgctcaccacttnaggaanaccatcccggccaggacggtntagcccagcaccaggaagaggaccttnagcanacggtcactcttctcctccanctccttggcca

SEQ ID NO: 2627 - DNA, 478 bp, Homo sapiens
  Genbank Accession No. N67876
  unsure (1)..(478): n = a or c or g or t
agtcaagtactttcttaaagaaacaatagcaccacattggcatagctgggccaaacaataaatgggaaagcaaaatgtgctacatcttttattctaagccttctcccaagtgcataaaatagtaacagaaaccctggagccacagagcatgagatcggtttcatctacacaaacattgacgttccaaggagaggaaggattctcaagggtggacaggctttttgtttgtttgtttgttttttaataaaattttcaaggaagtgatttcttttcagtattccattggatccttagggtgaatgtgtgtgtgtgtgtgtgtgtgtgtgtgtgtgtgtgtgtgtctgtgtatgtagggtgggtgttaagagattttcatatccctaagaaagagtggattcngatggagagctgcattaactttttcaggggaactgcctcatcttaaaaagtncaaatctcgtgccgaattcctgcagcc

SEQ ID NO: 2628 - DNA, 290 bp, Homo sapiens
  Genbank Accession No. N67893
tttttttttttttttttggcaccaaattagaacaattttattatttaacataataccaatgtatatacattatcctcccaaataagaaacaatttgattccaaagtttaaaatgtagtttccaaaatgaacccttgtaaatttgaagaaaaagaaagaaagccctgcaagttacacaaattttgatccatgactaaaataggcaccctgtaccaatcacctttctcatacaaaaatgtatattataaataaaactttcaaaaaagatcttggatgttttattgcacatca

SEQ ID NO: 2629 - DNA, 393 bp, Homo sapiens
  Genbank Accession No. N67974
attttaattaaggtttatttcaatagcaaaaatgacttcaagattttgcgtgaattattttttaaacaaaactatatgaaaaatatgtacaaatcagtcatcaatgtcattgacatttttatgaacaagtttcaaatgaaaaatatcccatcataacaaaggtacataaataaataaatgctgacaatactggccctaaagtctaacacaactgttagactaatcaggataccgctttctactacgtgaggagcacataatcaatgtttccagcaaaaggcaagtactggtttgtgtaggtttatttaggccagttgacagccacattattttgaggtgtggctacttgtttctcttcatagtgttgaatgggcacagtgcaaggcattgggc

SEQ ID NO: 2630 - DNA, 357 bp, Homo sapiens
  Genbank Accession No. N68018
acagtttcaatcttatatttattctcttgtggaatgctaggtttaatgttacagtatggttgtcaaagctaatgaaatgtgacaaatgtctaaatgctgcagaacagtataattttaattaaacaaaacacctgttattgtacagctgaggtctcgatggttgttaaactgatgcctatgtgtatggccagccacaaaccttggggatgtttattacctgtacatatatatacaaatatatcccatacatatgtatgcacacaggcatgtattaatttatgcgtgaaacttataaaattatatatacaaacacatacatgcacatctatctacatatacctaccctcaccattgagt

SEQ ID NO: 2631 - DNA, 457 bp, Homo sapiens
  Genbank Accession No. N68038
  unsure (1)..(448): n = a or c or g or t
tagtgtttcgtnggaaacaattatgggaagattcttaatgttttattagtctaaatatggagccaattaatcacttcattaatacattgaaaactattctgggaatattgagcataatcttactcttgtacacttggaacataagaggaatttttccaattaaaattaattgactctgatttttaaaaaatctacttgatcaggagcacattgctttgctggtgtctgtgagcagctggagatggtggtgaacggtctgtttgcatttcttggaagaagatcttttattctgctgctcaaccctggtctctgccttcccttagagactggagggcccatccttcagtttccctggattctgggagaatgggcccgcagcctccccactcaggggcttgggctggtgctccctctagtccatcccagggctnggaagggacatccctgggcggtaaaa

SEQ ID NO: 2632 - DNA, 275 bp, Homo sapiens
  Genbank Accession No. N68133
taatgagaaaataactgtatacttgcattgaatgcctcacaatcactctaaaaccaaagcaggataataacatttaagtggttaacatacacaggaaaaccagatacagagtataatttccaaacacagtattgctgcttttttcccctcctcccccaaaaaaagaaaaacaaagaaaaaataatttgggtaaagagcaacacaaaatcaaaattggcagctcactgaatgcttaaaattcaggaaatttgttctttaactaaaatggaatatat

SEQ ID NO: 2633 - DNA, 271 bp, Homo sapiens
  Genbank Accession No. N68241
tttttttttttttttggaggttgtaataaaaagctatttaatgtttgatagacaaattgaagtccataaatctccttgaataaagatgctaaaaatgttattcttgttttttaaatagtttcgtttttacaaagttctgtacataaaaataaatatacagaaacaaaccccatcaactgtccacatcagtaatcctcactggtgggctcaccattgataaggaagacatcattcaacgcaacctgtcacagagactgtcctagcagcaagg

SEQ ID NO: 2634 - DNA, 477 bp, Homo sapiens
  Genbank Accession No. N68385
  unsure (1)..(477): n = a or c or g or t
gaggaattaacagtctttattgggctcagaccaggagtccgtgggtcttgaggacctctgtgtatttgtcaattttcttctccacgttcttctcggcctgtttccgtagcctcatgagctgtttcttcttccggtagtggatcttggctttctctttcctcttctcctccaaggtggctgtcaactggcctggtacttcccacccaaccttcggtgaagccaggcgccccaagataagggaaaacttttctttggtagggcttcaaaacgcaccgacccttgaaggggcaagcaggnaaccaacaatccggcttttttccttggtccgtaagggccggtttggaatgccggtnaaaaaaacctttgaagaacnggtcccanaagcgggccttgggcctccgcttnggggtttttgttgggggcancaataacctcggaagggttcngccaaaaaaaaatncgggcttggggggccct

SEQ ID NO: 2635 - DNA, 439 bp, Homo sapiens
  Genbank Accession No. N68596
  unsure (1)..(439): n = a or c or g or t
aggatcggatcacacatttaatttcgacagtaagatgtgatgtgttttgctgggtcattatataaattgtgtttgttactaagggtcatgttcaaaagaacttggaagcccctttccatagcgctttatctgtccctggctggttgctngagtcctttatgacagttcatgtctcatcctctttgctagcctaccaacttcttcaagtggcattaacatctgaattacttttcctgtgctgcagtgatttccataatacttttcacagggtgggtgcttagtgaacctgttcaagatttactttgtacttattttgctcctaagaaaatttctaaaacatactttaaaattatcaagtgctatttgtaattctattttgttcaggtaatagcaataatatgtgtaggatggcattcatgaaagcactgctttttaaccc

SEQ ID NO: 2636 - DNA, 402 bp, Homo sapiens
  Genbank Accession No. N68730
  unsure (1)..(402): n = a or c or g or t
cataaagaaaagaggtttatttggctcatgattctggtcgctggaaagtccaagactgggcagttgcatctggtgagggactcacattgctttgacctcatggtggacagggggacggggagccagcattaatatagaagagcagggatcccctgcctgaggaggaccaatgcaggaaaggccaaagagcagttaaaaatcagcatcccgagagaatgcaagatgttgtgaccaaggtgtctaaatatcaaacgcaagtcaggcggtaatgacttctcggagggagctggcttcggctcaggcattccgggtgggggggaganggaaactnaagacaaaactgtgcttctcgtaaaggtctaattcaggatcttctcctttgcccccaactcccagaccggg

SEQ ID NO: 2637 - DNA, 417 bp, Homo sapiens
  Genbank Accession No. N68871
  unsure (1)..(417): n = a or c or g or t
aaatggctaatcacttttaatgcaatttcaacataagaagacctaatgttaagcaatattttaacccctctccccaaaataaaaagacccagaacactgtaactctaattatccttctcccaacttagagaggattattcgtccagtattttcgttttgttagtagactgttctttttttcttttctttttttagagatggggtctcattttgtcaaccaggctggaatgtagtggtgtgatcatggcccgtctcagccttgaactcctaagctcaagcaatctcccacctcaatttcgtgggtagctgggcctcacaggnattataccatcgcatctggctaaattttttttttgtacagatggggtcttggtacatctcccaggccgatttcaaactccaggcctcaagtgatcc

SEQ ID NO: 2638 - DNA, 408 bp, Homo sapiens
  Genbank Accession No. N68921
gaacaagtacaaatttagcaattttaatcaatattcttgcagacaagtgtggatatgtatatgcatatatacatatatatatcaaaattgagaatttacaaataagatttgatacatttattctagcagtgggtaagtccatagagtaaatttcaagtaggatatatttattttctttggtggtgtttttaataattcctttctactgcatacaaagggacctgaagcttaaattcagttagttttggagaaatccaaaatgagaaaaacagaaagcatgtagcattccatgaagcaagaacagcgtgcatatgctattcctggaaatactgaagtgtccgaatttcatgcctaaaaagtctgggaaatcacactgaatcagttgctggtttctgatgtctctgggat

SEQ ID NO: 2639 - DNA, 440 bp, Homo sapiens
  Genbank Accession No. N68974
  unsure (1)..(440): n = a or c or g or t
aaattaaattttttattcatttttttgcatcaaaatagtgcttaaaattggaatttatactcacaagacatagctaacatccaaagtagacaattaaaaaatattatttgaaaattatgtacttagtactgaagacttcctaaatttgcacattagctagattgccattagcaccattagagagttgatctttggctaatgattattcaggaaaatttcaaccattacaatcagtgagtataattttatatttcagcaacgatagtgggtcatgttcagcaacagcttcacttacaaattaaagtaagctcacttcagtgttgcactctgatgctgtttttttaccccttctcttgcaaataaccagtgaaataaaaattgcctctaactggcaatcgnaacaagggaggaattatggctagncaactagttgctaatga

SEQ ID NO: 2640 - DNA, 451 bp, Homo sapiens
  Genbank Accession No. N68993
  unsure (1)..(451): n = a or c or g or t
acacatatatgttcaatttatttttaaaagttaaacagactatttttaaagcaattttaggcttacagaaaaattgatggccggacaaggtngctcacacctgtaatcccagcactttgggataacaggcgcgacactgganactgaccttgttgctgtttatgttaggtcagggaaggcctcacagaaaaggtgacgtctgaacagagagctgaagaaagtgaggaagaaggcacatggacattagagggtgggaagatagggaagagcacaacccagatcaagggagaagccaagtgtaaaggccctgaggggagagcnttgctncacggnaggccagccatcgggggccggggctggagtnctacaagatgagggcagagaagccagttgggccggggtcctgtngggtncagatcntgggtcctgtngggctctaccantccctcca

SEQ ID NO: 2641 - DNA, 392 bp, Homo sapiens
  Genbank Accession No. N69014
  unsure (1)..(392): n = a or c or g or t
ctttttcggggcaaatacactttattcagtcctggcatcagactggcggagtcctgctgtgggtgccagtgccccagacagagggaccccacccctcagctacgagactagttctccaagaccacagacagtgacatctcttcactcacatcgacgttttttttttcattgtctttttttgttgttgttgtttttcttaaaaaaaaaaaaaaaaaaaatagagcgcaagaaaggcccagaagccggagcaccaagcttaaaggaggcagctggtggctttgtcagcgacggggaacgcntggggcagagaccttgcaagaagaccctgggcagggggtccgggagatncttggggaccgttttntttcctggaagaattttgtggtngtgtg

SEQ ID NO: 2642 - DNA, 479 bp, Homo sapiens
  Genbank Accession No. N69084
  unsure (1)..(479): n = a or c or g or t
tggatgcaggaaagtttttatttttaggtgtacatcggctcagtggaattgcatccagaaaatctaagcatagatcaaagaaaacgaatgtcttttaagcattttgaggcaggaattacgtgaagcaggaagcaggcttacagaagcaagaacaaagtccattaattatcttgtgacacttttgcaacatgtcttacatctctgggaaaacttagtatgcagcttatgcttatctgtcttgtgaccttgcagctgtacaaggagggaagaaaacacaagcttacagagcctacaaaatacctgaagggcagatatgggttaatgtttcttgggactggcagttaatatccttctttaactctaacttcaggggggctacttaaattctttttagccttggttggtacagcaattcattctatgagctattatttcnggttactataattttaccaattattacctaatgcnaataancc

SEQ ID NO: 2643 - DNA, 433 bp, Homo sapiens
  Genbank Accession No. N69114
  unsure (1)..(433): n = a or c or g or t
cactcttcctcctgtccaccctctgtgagtgatttaaaaacggaaaaggtcaaagcccagccaggcctacatttagagaaattttaaaaaaatttttcctttcaattttggccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaaagtaaagaactggaaaatngacaaaccttggtaaatggcacttccaaaaccaattgtg

SEQ ID NO: 2644 - DNA, 176 bp, Homo sapiens
  Genbank Accession No. N69136
  unsure (1)..(176): n = a or c or g or t
tttaagaatggacatcattttatttcattttaatttagttntgtttaattctagtttcagttttgatgatattttgccatgcttcccaatttttttctttgataacaacataattcagggagaaagtacaaatttgccacaggttgaacacttaatttgtgttccttaaaaaataa

SEQ ID NO: 2645 - DNA, 290 bp, Homo sapiens
  Genbank Accession No. N69216
atatttgtaactatgcctgtttaatgtataaaatatttaaaagactgaatatcacaaattaatagtacatttttacaatctaagaatattttctaaatatgagctattcaggggaatgtgattagtcaatgatgtctttgatgccctgccccaccacaaaccaatagggtcaactctgtgactgggcacacatcaaagattcaggcctgactctcagctgtggggtttgttaaaacaatgtggaaagttttcttttatgaacaagatataatgttcaaaaaaaagggtgt

SEQ ID NO: 2646 - DNA, 371 bp, Homo sapiens
  Genbank Accession No. N69252
  unsure (1)..(371): n = a or c or g or t
catcggggatattttttattgtgccaaaaagttgccatcactgtcattaaacctgtttaacaccaaataataaggaaaataaaataaaaaattcgggcttggtgcagaaactcactccaaataaattacctaccaaaatatttacataatgatggaaatattccaaaattccatattttgggatttatacacaaaagataaaaaaattagaggccaagagntgccagaagtgaaaaacggggcctggaaagcgtttcgtgaggaatgagctgggcctaaagaggcactgnaggcgggactggggcctgcagaagcggccgaaacngcgaagctttggactggggaggccgcagtaaggcgagactaagctg

SEQ ID NO: 2647 - DNA, 437 bp, Homo sapiens
  Genbank Accession No. N69263
ggaaaatcaaaatttttttattaatttactggatttcctatacctaacaatccttaaaacaactatcaacagctgcaacacaaaccacaggcaaaatgaaaaacagatgccccagacagcaccccaccacatggcacacacttaataaggaacaaaatcctacagggtgctgacataactcgctttaagcatgcaatgattcctgcagtgctccctggcaatcaacctctctgcaccctggggctggatacttcaaagtctttgttctcttaacaggtttgaagtcaacatggcaagttaaggacaagttagatgagatccccctagttcataacgtgagttcctcttgctctccaatgttcatccacaagtacagggtccaatcccctataagagatgggcttaagcatcccaatggggaaacagcctggccagcc

SEQ ID NO: 2648 - DNA, 374 bp, Homo sapiens
  Genbank Accession No. N69299
gaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagttgacattctttcaagcatacttgtaaaatgtttccttaaagtgtt

SEQ ID NO: 2649 - DNA, 176 bp, Homo sapiens
  Genbank Accession No. N69390
tttgagtttgaatatctttgtttaaaaggttagttattttttttaagtatagcgtgagaaatacaggccattattttcaaatatataaaaacatctccagtaagttccacacagaattttggaaagctaagctggactcagagcaggtctgctgctccccaaggcactacccttcg

SEQ ID NO: 2650 - DNA, 402 bp, Homo sapiens
  Genbank Accession No. N69879
  unsure (1)..(402): n = a or c or g or t
ttttttttttcccagggagccagagcccacgagccatttattgccatgttttaaaattcgtgcaaaatatctgaagccctggacagagaatacaaagtgatattttcccaagaaacataaaactaggaaaagaggtgggggacattttcccaccagagctccccccacgccaggccccaagcagggtgaggcctccaacccggccagctgagcaggganggactaagagctacaatctggaccagggaaggaggggtggaatttgcaacagcgtctcaactaccaacgagaggaaagccagtcaactgtacaagtctcctatcaactttttaaaaaaagagaaaagctgtaaaagtcaggccctgtggtnagggagcggccaagtccccagccagggccgga

SEQ ID NO: 2651 - DNA, 458 bp, Homo sapiens
  Genbank Accession No. N69983
  unsure (1)..(458): n = a or c or g or t
tcccaacaaaacgcaagggtgttctgctctttactaaataaacgttcccttcccagaaaccagccccaaactcatcactgttcaaatatgtggcaaggtgaggctctctgtccccctttaccaggagcacggatggtgtctgcaaggcagtgcctctcgagtcgtcagggagatggcccctcaggctcccaaacctgccaaatacaggactgtgagcggctcgggaggggtctcctttgctctccatccagcgggtcagcgggtccttgcgggggagaaagagccaaacagccgcctttcccttctggtcacagcacgagccaggttccaggcagaggctgtggcaaacattgtcatcgccccatggtgaaactgggcacttcctcctcctcctctgttccagatgnctccgnagaactgctggacccctgctccttgggctgaccgggtccttcttg

SEQ ID NO: 2652 - DNA, 435 bp, Homo sapiens
  Genbank Accession No. N70005
  unsure (1)..(435): n = a or c or g or t
ttttcggataaggctgtgctttattacatgcataattacaaatctgtgctaagtgaaaatgtataaagcaatggcgacctgggtttaagccacacagagaaagggctggacaatccattaacccttctgccaatgtccattccattgcttttaacatgattgtttccatttcttacaatttgcatagcacttacttgtcaacttgctttgaattcattgtctcagtttatcctcacaacaaccctgtgaggtaggtagggcaattaacactatccccattttgcagatgggaacactgaggcacagagcggttaagatctcgaggctagttagtagaagcatagggaatagaaatcaggtctcctaactccccagtccacatcttcctttttagactangttgttccgcatgactagggagtagaataaagcgag

SEQ ID NO: 2653 - DNA, 435 bp, Homo sapiens
  Genbank Accession No. N70057
tttgggtggaagggtgagccatgtgttttttttattttaatttttaaaaaatttaaaaaattccctattcaaaggtcaaaaagccacataagttttgatgatgatcaatttgaacggaggctcgagatggactgagaggactgagacacagaagtggggggaccatggtttttactggctggaccacagggggaccctgtccacccgcctgggttgacggaaggtgtctggggtgctcaggtgggtttgttctcagcaatgcacggcatacgtcagctcttggatcctccttggtgcctctcttgtctctgcccctgaggtcaggtccctcacttgctgggcactggcagcctctcttcgatgcagccaacacaggcaggcggacagaaggaccactgccagaagcaggagcccgcccagccccaggcccccgta

SEQ ID NO: 2654 - DNA, 469 bp, Homo sapiens
  Genbank Accession No. N70305
  unsure (1)..(469): n = a or c or g or t
atgattaatttgttttctttattgcaaaaaaaaagaaaaaagaaaaaaacatttgttcaaaagctacctcaaaagtcctcctaccaaacatgatttggcaatctttttgcatgattagtatgatggcagtaggagctttgtttaataagcaaacatgatgaaaattccaaaaggtgctatgcaaaagatcagaaggaagatgtttttcctgagaccctctgccaactgttacttctgatgcctttcctgcttcttgaacaaggcttaagacagcttctctgttccatttctgaccactatgtggcaccagaactttgaagtaggaaatagaaaaanaatctgcttaactagtgatttgctgtgaatctttaatcaatgcctcttaaaaataattcatttatggccgggcgcagtggggaaaagcaggttaaaaaacatgcagatcactcttgnccactactgtggtccc

SEQ ID NO: 2655 - DNA, 500 bp, Homo sapiens
  Genbank Accession No. N70330
ctgttctcaactttggtaaaagagagatcttgtgtctcactggagggtgcaccaagcttcaggcaagaaactgtgagctggctgtcaacagaatatggttcttatcaaggttcttattaatgctgtgcaaacaagggtctcgtcatttcagtaactatttgtacatttataaaagcaatacagtcatgggaaaaaccaacaagcacagcttggtagaataacctgccatgaaatatcatcggctttataataatttactacaactgttctttttattcacactggataggaaatgcttccatctaacacatggaatacgaatatacacaacacaaatttggctttaataaaaaaaaaacagttcaaaaggacaataacacgggggctggaaaacaataattttgtggcagtttcctgattcataatcacatgtctcctgcctttttacagggaatggacacaagtattgatggattttgtaaaccagtttaaaacatttt

SEQ ID NO: 2656 - DNA, 444 bp, Homo sapiens
  Genbank Accession No. N70358
  unsure (1)..(435): n = a or c or g or t
ccaagaaaataaatttattaaactttgaaggaaaaaatccacagacataaagagagttaaatataaactgccagacacaactagtcatactagtgaataatggcttatgtggccaccaaagtaccaaaatgacattctgagactgattgaggtatttagctatttttggctatagaaatgttgtcaggctgttgtgaaatagtaagatagtcttccaaacacacagctttgaattgaattaggttctacactgatgatactttatatgaaactaaattatgtagctcttggagaaaaccatagcagcaaagtagcagaaaatctatcaaacatctattacaaataacatgttgaactttaaacactcaattctagcttttcatagtccttcctgcaagagagagaatttaaaattatcagccattaagcttgcntcctaaaaaa

SEQ ID NO: 2657 - DNA, 442 bp, Homo sapiens
  Genbank Accession No. N70481
gaatcaaaggctttatctttaagaaagcagatttagagaatcagaattttcttccattttggttctattaagaaaagtataccaaattaaaaattaagaactattttttaatagataatacatgtacatggtacaaaattcaaaaggtacaaaaggtgtacattgaaaagtcattcccacccctcttcccagaggcaattcaggctgccgggctgctagatatcctcccagagacatcctaggcatatgcaggtggacatatgatatacacgtgtatacgtctgtgtgaaaacatatgcacacacatacatctacacactttctccattccaaacattaggataccatgggcttttttcctcacttaatcatggcatcttggggcccattctatggtagtacacacacacaggatccattggttttaaatttctacaaacta

SEQ ID NO: 2658 - DNA, 446 bp, Homo sapiens
  Genbank Accession No. N70577
tccaggagaatgactcagtttattattctcaatttgaccctatgtatcccactgtaggctcaaacactgcacagagctgccacgtctaacctcgtaacaactgcgtccctggaaggtgaagggggtaaaccacaaagtcagaaactttgggaaaagccacggtcgcatgcacacctctcaaacaaggaaacaaactacaagaaagggctcagtcattgtacacagcaagtgtgcagtgggcaaagttctgttcttttgacattggccaaatgcgtaagtccctggtttcttgggctcaatcacggtccaaggttagtaagaaggccaacaatgttgtgagcaggattcaatttctacagggtcatggggcatcatccaccatgtgaaggggctccagcaggttggacatgatcaatacccatccagattaggaccctgacgccctt

SEQ ID NO: 2659 - DNA, 221 bp, Homo sapiens
  Genbank Accession No. N70678
  unsure (1)..(221): n = a or c or g or t
tccacaattgcttaaaatattttattaaaggaagaatacaatttaacaaaaaagtgtttattaaaaggggaaatatatagtaatatgtttaaggcacatggcaaacttttggcattaaattgcaagaaaaaagaaatacaaattatcacaataaatttcagaatctgtttctttagtccaaatagtttttttaaaaaagtctgaacagcagcagcngttcc

SEQ ID NO: 2660 - DNA, 318 bp, Homo sapiens
  Genbank Accession No. N70861
  unsure (1)..(318): n = a or c or g or t
agctttttaaaatataatttaaaactattttgtaccagtacaatatattaattttacaaatgtaaaatttttatcagctgttaaagcatttgcaaaaaccacacattctacttcagctttattgcacaatatctataaganaatattaatttttaaattagaaaacataaaaatgctttcaatatagaagagacaatctgattttaaagacaatactctataagaatgtctactcagaaaataacaaactttcacaggataccagctgggcagatgcttcggcagatccggtacaaagcactgtttaaaaccagtcca

SEQ ID NO: 2661 - DNA, 279 bp, Homo sapiens
  Genbank Accession No. N70903
  unsure (1)..(279): n = a or c or g or t
aacatcgcatggcagatgggtgttggaataattactttctccacaatctatcattttaatagtttataatagtgcagttcatggaaacatgccaagtccaacaaaagcacaacagattagattacagtcagattgagaagactgggtgtgcgttggcagatagacgtgctggacatgctccacacgcgacctgcagacgggacatgactgggaaaganaagccaacagtctctgttagcatgcaagcctcggtggggggcctgtgtctctgtgcacacc

SEQ ID NO: 2662 - DNA, 443 bp, Homo sapiens
  Genbank Accession No. N70966
aggttagaacttctgaagtttaattctacagcacttgtgagcatttatttctcttttgggtcacaaaacttggaatgggatttgggtatttgagtaatgggttaaacatatatattgattagttcaggaattgagtgactttaagatcgcttatcagacacttttagagatcccagcaagaggcagattcggtttctggtttcatagagtttacagtcactgaacaagtctttaaaataagtagcaaattctaagttggggataggtgaggcttcttgggtagacaccctgtctgtgttcccggccaagacttgatgattctgatagatgtactggaaatgctggagaaagactcaggcaagactggtgtttttgctgctctctctagtttaccacactgggctttcagaattgccttggggaccagaatccagggccaccag

SEQ ID NO: 2663 - DNA, 470 bp, Homo sapiens
  Genbank Accession No. N71072
  unsure (1)..(470): n = a or c or g or t
ttttggagagaaggataagcaatttattaaccccacgcccctagcaccagctgtcaccttggacttgttggagatgcaggggctagaaaggaaatgacagagtgtacaggccccttcgaccccgtgtcccataggtnggttggcccccagacacaccctctctgctggcagtgcagaacatgcatcccaataccctagaggagaaacaccaccccagggagagccctttctgctccaacctcctgggcaggtcccaggttggggcagcagcaatctgcaggtgtttgtcaggcctggccacacattgcggacagaggatacgactggggtaccctagggtgtggggagggtcggcctggggtcagggggcatgaaggctgtgttccagactcctcctgcccccaatcctctgtgcccctgctggagctctcctagcttctctgatctgtgctcctgtctttgggggaagc

SEQ ID NO: 2664 - DNA, 359 bp, Homo sapiens
  Genbank Accession No. N71542
gaatggacaataagcttttattgcattgaaaggtcattgcagtgaaaggttggggattgcttgctgctacagctgaatggattctattctgaccaatacacacagaaagagatcacagactccctaccttagaagaagggaggtggtagatgaaatgaactgtatgaagagccactagcctggcccacacacagaagaaggactggcccgtcttcttgaagcccatgctctggtagagggccatagcagagagctggatggtgccggtgtccaggataacttcactgtagccctggtcccgggcaaacttggaggacagtccttgaccagggcttttgctatcccccgacgacaggggc

SEQ ID NO: 2665 - DNA, 427 bp, Homo sapiens
  Genbank Accession No. N71781
gacatcctttgtatgtttactataataacagcaaaatttttccaaaccagagccaatttccttggctctaggtacaccccttccaagcaatgcaaaggacatctccaatcatgacatttaagacaattctttatttctctgacagtgacttcttgaagtgcacatataataaataaatagaaaatatatctttgttcatggtgatgcctacaagaaatgtttacatacaaacactctgtacatctaactcccgaaaaaggaccagctatttcggcaacagaaaaaagacaagcatttcagaggagcgttgcttttccttaaagacctaactcacttaagtctttaccaaacagaaataacaagggaggacaattttctaagcaataagaaaatttgtggctaccaaggaaaatgcctagatattggg

SEQ ID NO: 2666 - DNA, 248 bp, Homo sapiens
  Genbank Accession No. N71935
atattttcatttttcatcctaatttactgaagccattttctttggttagctttagaattatctttctttatactaaccagcttagcatgtaataattcttgcccatgtgactacaaaacattagatatctccacaaataaaaacgagattcaccaacacaaatattccttctctttaagttcacaaaatgcaagaagaaaagaaaaatgatgttaggttgtcagtaaggaaagcatttctagatgaga

SEQ ID NO: 2667 - DNA, 507 bp, Homo sapiens
  Genbank Accession No. N72116
  unsure (1)..(507): n = a or c or g or t
ggattttttaaaaagttttattgaaatgtagtaagttctaaaataaggcagagaggtcatatatttaatgctgaaaggggaaagtgatgctcaaagtcacacaaaggctgcaggatttgctgactcaacacctttggggctagaaagaaatgaggagtgagctggatgcagtggttcacgcctataatctcagcactttgggaggccaaggccagcagattacttgagctcatgagttcaacaccagcctgggcaacatggtgaaatcccgtctctacaaaaaatacaaaaattagctgggtgtggtggtgtgtgcctgcagtcccagctatttgggatgctgaagtgggaggatggcttaagcccaggtggcagaagttgcagtngagctgagatcacaccactgcactccagcctgggcaacagagcaagaccctgtcttaacaacaaaaaacgcngggtgcagtggctcacacctgtaatcccagcactttgggaagctgaggc

SEQ ID NO: 2668 - DNA, 449 bp, Homo sapiens
  Genbank Accession No. N72200
  unsure (1)..(449): n = a or c or g or t
gtttaaaaccaagctactgcagcttcaagtattttgcattacatagaatattttttataaattagttaatgttatattttcaatattcagacatatactataatatatatacagtacaataaatgctctcattctttttttaatttttttggataaatccctgagaatgtatgttgacagtcgctaagtttccacatgcacaagcatcgtgtgccatgcttctggacgaacagcactgcaaagccacatgggtcagccctttttactattagtatttcattttgttggtttgtttaaatatgctgaaaatgtaaagatgagttacaaaggagtaaagctgaatccattcggggtacttatcacaggatgggaggngtttgggttnggttttnaaagccattccaattaatttttttttggaaggcctnttgaccgtttaccggaaacng

SEQ ID NO: 2669 - DNA, 483 bp, Homo sapiens
  Genbank Accession No. N72259
  unsure (1)..(483): n = a or c or g or t
gtaaatgtatccatatataatcatcgacatgacagatgaggaaacccatgaagtttcccactagtcagatatacattttcacttcatcagaagcacctgatatctacagctaatttataattagatactgtttcaatgaaaccaaaatgagccctacaagttcctataaacaaaagcttccaatgtactaggacagtcagtaattaatgcatcattcagaggattatggctgttccctaagaagtgcaagttcaaacctgtcaacaccagaggtaatcattttatattaatttatacgtaataccatttaaaatctttatctggagtataacatatggaaaacagtctttccacaagcaaaaatgtgggaaccatttaaaaaattaaggagtcattttttaaaagtaacggatcagattccacaggctactctnggacaggatctggcnggatagaatcccttcatttggtggcttttggcag

SEQ ID NO: 2670 - DNA, 292 bp, Homo sapiens
  Genbank Accession No. N72695
  unsure (1)..(292): n = a or c or g or t
tgtgcttttgacactttatccgtttttatttaaaaacatgctaaaaacatggtgttccataaagccaggaccaggatgaaggaacgcacagatacggcaatgcaagcagaaagtgcatctgaaaccaacaagcgtgctcaccctgctctccctcccgtgctgcccgggggangcaaggtgggcaaggagggggcaggaagcccccatggcctcacctcctgagtccccaatcagggcagggaggccaggccccaccctggactattgactcactgcagtggggaggaggaaa

SEQ ID NO: 2671 - DNA, 413 bp, Homo sapiens
  Genbank Accession No. N73278
  unsure (1)..(413): n = a or c or g or t
tgaagacttaccttctgttaatacttagattacttaaaagcaacaggcttgttatttgatcataataaaatgttttaacaaagctactggtgcaaagggtgagaaggtggcttaaatccacattctaaaacacattataactngaaataactgaaatatacactatataaaaaacattataactgaaatatacagaaatcactcgaatatattatcctactgactcattccttctgtttattactgtattgccacattggagttccatatttccagctattctttctacggtacaaatggttccacactaccaaagagaaaagaaaagctcactgagctttaaccctgagagaactcagagaaaaatacccctggtggcnggtatcncacagggttatacccgggaaaaggaa

SEQ ID NO: 2672 - DNA, 486 bp, Homo sapiens
  Genbank Accession No. N73461
  unsure (1)..(486): n = a or c or g or t
aacgaagaagtgagtattttattattttgctgtacagctgttgcttcactatataaaaacagcaccagcaaatgcagtgtattgcaaaattaagatagtgttgttcttcatctgacactgtacaagcaacaaaaacttcttcactcccagttatttccaatcggaaagatcattaagtatttcatcccaaatccaggtatggacatacacaagttacaatattatataaggcttaagaataacaacattatctttgaattatgtaatttttgtaactaatttttaccatggataatttcatggataatttcatgaatactagagcctagtctaaaaatcataggatgttgtgaaaaagacacatattatgtttatctacaatcattagaaagttaaaaggcatcttctttcattagcagtgttaacagtagtttttttttcccatggggaatgcnaaaagttgcnattccaagtcctcnatccacg

SEQ ID NO: 2673 - DNA, 466 bp, Homo sapiens
  Genbank Accession No. N73468
  unsure (1)..(466): n = a or c or g or t
tctccattcaattcatatttaatagaccaccatctcttctgccttcatcaggaaaaaaacaaaaacataaacaaaatagtatctgcctatgattaatagtatttaattacacgcacttttgtttgagtttacttccttgctttctgaaaaaaacataggtatttagacactagttcatgatgataaaattaaaatttagttttacaaacaaaaattgaaactgtcatttgtaggaaaaaaattcaaatttaaaattgttatttttcactattcttagatagcaagagaagtaagaatttctttactngngatttatatcacaacagaattttttccttgacaaaggaccttttaaaaatcccaggaaaggaccacaaaataatcaaagactgcacattgtaaataaaacccttcagctgttattgaaacataagtataattacacacaaggaaaaggtattataag

SEQ ID NO: 2674 - DNA, 219 bp, Homo sapiens
  Genbank Accession No. N73543
cctcattgtatattttatatcttatagaactttcattaatgaatcataggaatataccagctcttcaaaaattaagacattatacaaagtgaaatactaaaaacagaaatatgtgtttttctcaaataatatgcttctcaggaaagactttacagaaacatctcttcttatccgaaattacatccaaaccctttttttgtgtgaagtgttgcttccagt

SEQ ID NO: 2675 - DNA, 450 bp, Homo sapiens
  Genbank Accession No. N73561
tatcattgacctttgaggtgcactattaaattgctcagtccattaaaataacggattgctgatttaaaaactggttccttgcttagcttcagcaaaacagcaaagtctaccacattaaatgtatattgtttatttgatttttattcgactttgttgtcttattttaactacttaattgcaaatctgtcttggggttaacactgtgtaagagttttaaagcataagaagtctgtacttagagtttagatgtacgttttatatttgtacatgttgatgtaacattttaataataataattcaggtctgctgggcatggtggctcatgcctgtaatcccagcactttgggaggctgaggcgggcggctcacctgaggtcgagagttcaagaccagcctggaccaacatgggagaaaccctggtctctactaaaaatggtaaaattaagccagg

SEQ ID NO: 2676 - DNA, 129 bp, Homo sapiens
  Genbank Accession No. N73705
gagataattaggaaagaagatttattgtttacccttgcagtgtttatggggggaaaaggtatttacagaattactgttgctagcgagaatatacagtaaagtttaaaacattttggagaattgaatttg

SEQ ID NO: 2677 - DNA, 381 bp, Homo sapiens
  Genbank Accession No. N73762
  unsure (1)..(381): n = a or c or g or t
tccaattaaatcttttctttttttttatgaaaaaagatcacacagaatttgccaacaaacaaaattccaaaagaaacataaaaaaaaaaaaccaataattcccccaaaaaacaaacccaaagtctggcttttccttccctcaagattgtctggttgaggccttggtttcccttgaaggcttggggcctggttaagtgctttctgggggccaaggnngganccctggggcttgggccggctcctgcctctccctcttctctccctaacaaacacttctctatcctggggggtgagtacagtacacttggcggggtgggcggggggtttgctggggactgggnaggccggtgaanccggtggctagaaactntaatctaacag

SEQ ID NO: 2678 - DNA, 165 bp, Homo sapiens
  Genbank Accession No. N73808
ctctttgagtaactttattttggaggagttccataagcattaggaacatacataaaatgacacaccactgttgacaatgaaaaaaaaaacagcatttgatattttccagctttttaagttaaaaaatgattcagttaaaacaaaacaaaagtttagatattttag

SEQ ID NO: 2679 - DNA, 326 bp, Homo sapiens
  Genbank Accession No. N73846
  unsure (1)..(326): n = a or c or g or t
aacattcatcatgtgatttattccttacaatttacacacattattttacttaatcttgatgcaaccgtgattatccttattttgagagggccagagaggttacataacttatccaaaccaaggtcaccgcctcaataagacagcagantcagatttgaacgctgactccaaaatccaggttggtgaatgctgcacggtcctgccttcctgcggtgacactaatttactccatctaagttcccatcatctcctggtcagaaatccctgggnaaaactgagggcanagggaacctgcaggtttaccagagggaatcttgggnaggtct

SEQ ID NO: 2680 - DNA, 229 bp, Homo sapiens
  Genbank Accession No. N73865
  unsure (1)..(229): n = a or c or g or t
ttagtgcaattcctacattgagtactagataanaatactgagggccattttgcgggtcaatcaaaagcaacaaagaacagatgtccatttaactaatacatggagagagagaattttccactcactcagtgtactacagttgtacctgtaatattccacttggtgccaggctctatagaaaccatcnagagactgttccccctntggcnaataaanggggtttaccgga

SEQ ID NO: 2681 - DNA, 386 bp, Homo sapiens
  Genbank Accession No. N73883
  unsure (1)..(386): n = a or c or g or t
aatgttctaaaaagtacactttattaaatgtgagaagcntactggcaactgaaacatgggccagcagaaagtcattgcctcccaaatggctggactccccacaatttcactcatgaatataactatcaggtccaggaattgcagggtttgcttgcattttagtctttaagctaagaactgaatttccaggcaaatgtgtcttggttggggagagcagtcttaaatgaagagtagctttcaaaccactccatgtcttttttcaaatttcctcaaaggataggactcactttccagctgtagaaaaatggtcccnttctcctgcttgtggtgtccaactgttggaagaacgatgagtcacgctgactcgnagactttgacatcctgaa

SEQ ID NO: 2682 - DNA, 149 bp, Homo sapiens
  Genbank Accession No. N73988
tttcacacgcacaacttgggaatttaatcttcacttttcctcccataaatatagagtgagggtgtgataccagccccagcccagtctccttggggtctgcatctctgcttcctggcagcctcttgagtcgacttggggatttgacgtca

SEQ ID NO: 2683 - DNA, 147 bp, Homo sapiens
  Genbank Accession No. N74018
  unsure (1)..(147): n = a or c or g or t
ttgacaattttaaattataatttttattcctcagtcaccactgctaatccttcaatttatttcaaagtaacttctggtttttattacatttggaagataaagcaacttatcacatgtaggttacaacttaaaattcgtgnattgang

SEQ ID NO: 2684 - DNA, 141 bp, Homo sapiens
  Genbank Accession No. N74025
tagcctgatatattttaataattctgttattagtttactgcatcttataacattttcttttgaatcaagtcacagccgtgtgtactttaggctgtggcatcataaacaaatatgtaaagacacagagttaaaatagatgaa

SEQ ID NO: 2685 - DNA, 391 bp, Homo sapiens
  Genbank Accession No. N74422
actcataaaacttgtgtttattgaatttcagcctctgtggcttcttcaataaaatgttggctcccatgccttcaactcttctttgggcatgagaccagtgggttggaggatggggagtgtgggggttgggatgacatgcattgccctgcagggtgcctcggaggtagcagggccagccatgagaacaaaaagctctgttctttttgtcccttgggcctggcattggcagtcctagcaccacacagtggacaagcatgcccaccaagccccattggtaccacgaagtctcatatgctagtcctttctttagcaccatctctagaagaagcagaagcaccttattcagtaactcatttgagcatggcaacagatcctatggtagggcctccca

SEQ ID NO: 2686 - DNA, 436 bp, Homo sapiens
  Genbank Accession No. N74558
  unsure (1)..(436): n = a or c or g or t
tttgctgtaatacacaaaagttttatttttgactttcttcttttctgaaggcaaaataaaatagaactgaacatcagtgaattttgtacaacaaaaacagcttttaatatggaatagtccatgaacattttaaaatctcggaatggcttccctttttcaaagtcatgctttcttgcggtccacaaggagttggcacagaggagatggtggcagcggcgggtgaggtgagtggaggacagggcttctctcagatccgtgttagctggtgccacagactggatgggaggatgctctccacttttctccatgacaaagtttaagggggcaaacaaagtgctgaggaaagcntttgcgaagacccccataagttccgggaactgatgtgtcaggagggccagcatgctgttgaaggaacataatccagcagtaaagagaa

SEQ ID NO: 2687 - DNA, 496 bp, Homo sapiens
  Genbank Accession No. N74624
  unsure (1)..(496): n = a or c or g or t
tgatttcaagagctccatttttcttaaatcaaagtgtgactatataggggcctgagattaaggtgtgagcctacagaaaggggttcaaagcacctacttggtatatgttagtgaaatcgatagatcagaagcacaaaaagagtatttatcattccacatggtctgaaacaagacacaaagctagaagtcccccatataaaggtttggggttaaagcatttctatgtctgtgccaacaaggagaacttccaagtatagccatggccatagggtgtgactggtaaaagatctgggcatcttggattcaaagatcttatcattgctcacagaaagcccttgtacatgtctgggctttgggccagggcaggttagccctaaccatccaacaaccttcctaatcatcaccaggtaaactngggaaatttatcccctnggggatagaccccagagtgcctcntagggggagagatgggttaggaggccnaataccccagggg

SEQ ID NO: 2688 - DNA, 170 bp, Homo sapiens
  Genbank Accession No. N75072
atcaaaatgcatcttgtttatttggcttttgaaactgttataacacaacttataacattggaaatacattattttattaatacaaagtagttttcatagtaaaataccaaattaattaaaaggcagaatgaaacgtaccatatacatgtagacgacaaatgaaaactgtc

SEQ ID NO: 2689 - DNA, 539 bp, Homo sapiens
  Genbank Accession No. N75120
  unsure (1)..(539): n = a or c or g or t
ggcgtcccctctgaattctaaacagctaattctagacactaacatctggntcttataatttaccggtctggtatggacatgaacagttccagtgcctttcaacttatccctgaatttttctcttctcaaagttctaggcagtaattttaatgccctcaaattagataaagctgattacttagagcttataaattagctacactttatgacactaagaatagagctatgacttatgcatatcatacctgtcaagctacctagcaccacgaatagaactaatattaatggatggactaatacaaggatctaatatatgtcagtgatagtcttaaaaacaccgatttgttattttccttatatataatccaaattcctttctatccttctggcaatgtttctactgcctgactaccttaaataactatatagtgncaatttcttgcttgggccgggtggtggctcatgctggtagtcccagcatattgggaggantgcttgagccangagttcgagatcagcctgggcaacatggtgaacng

SEQ ID NO: 2690 - DNA, 286 bp, Homo sapiens
  Genbank Accession No. N75203
  unsure (1)..(277): n = a or c or g or t
ctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttnataaccacagttttaaatctttaatctgtgcataataaaaagatatatatcagttaaaaaaaaaaaaaaaaaaaa

SEQ ID NO: 2691 - DNA, 177 bp, Homo sapiens
  Genbank Accession No. N75541
tgcaaaatctgttatcagctttattagggaaaacatcaggtctctttacacgttgaacaggaactgctggttaacaagacacgattaacttgctaggaatggacaaggacagcgacaggatggtgcttcacagtgcctcctgctgatggcaccttcattctggctgcagaattctcc

SEQ ID NO: 2692 - DNA, 212 bp, Homo sapiens
  Genbank Accession No. N75870
tcagcactgatggaaaataccagtgttgggtttttttttagttgccaacagttgtatgtttgctgattatttatgacctgaactgattatttatgacctgaaataatatatttcttcttctaagaagacattttgttacataaggatgacttttttatacaatggaataaattatggcatttctattgaaaaaaaaaaaaaaaaaaaaaaaa

SEQ ID NO: 2693 - DNA, 241 bp, Homo sapiens
  Genbank Accession No. N76012
taaaaggtaaatcatttttattgccacaaattgataaattgttgtgaaaaaaagagaaactggcacacatgaaataacacaaacataagaagatataagaccaaaatagatttgaattatgtctcccaggctggattgcagtggggcgatctcagctcactgcaacctctgcctcccaggttcaagcaattctcatgcctcagcctccaagtagctgggattacaggcatgcaccaccatg

SEQ ID NO: 2694 - DNA, 175 bp, Homo sapiens
  Genbank Accession No. N76086
taaaacaggcttactttcaacatccatttacaaacatttgttgaaaaatattttaggagtatttgtttaaacattattccgaatttactgctccataaagcctagtgaatatttaaattcttgaatatgttgccagaaaaagaagcagagatccaaaaacaagtatatgaccaga

SEQ ID NO: 2695 - DNA, 481 bp, Homo sapiens
  Genbank Accession No. N77326
  unsure (1)..(481): n = a or c or g or t
gaggagccaatccttcttggcagtctggcccatcagatctacaggatgatgtgtgcaaagggctactcaaagaaagacttctcatccgtgttccagttcctacgagaggaggagaccttctgagtgtgccctttggcacggacactgttgggaaccaaactctgtcttggagcctccttttagctcactccacaagtaaatgganttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcg

SEQ ID NO: 2696 - DNA, 520 bp, Homo sapiens
  Genbank Accession No. N77606
gcgcttaggggcttggactactgggtataggacttgctctagctctcaggtcctagcccaagctcaatgcaaacacagcccctccggtcatctgtttctgtgaggttctggaatcccttcctctgtgtccgtgagtctgacagaatcgatgatgttcccttagagctgggaaattccatgtgtttattcacggagggaactcaccattacctcccttgtcttctttgcctgccttggagaaatccagagtcttcggaatggcaaaggcagctcctggatttccctggagggacggcactagctgagggaagtagctcccttcattcatgatgcacagtttacgcagcagacacacaactgcgcctactaatttgctcggtgccctgcaaggtggctgcctaactttgatttgttaatttcaagctctctccaggatagtgccaaatggtgcaatgggaaacctgttttgctgggggggctctaagatcactggctccagaactcccgggctgcaagggta

SEQ ID NO: 2697 - DNA, 329 bp, Homo sapiens
  Genbank Accession No. N77947
  unsure (1)..(329): n = a or c or g or t
gctgctgcatcggttttattcctcatgggtagatgaacacacactggtatatggggaaatcctcacccgccctccgctgctcttctggaggtctgtcctcttgctttcctcctctgccccagcctggtgctgccccaagccctgccctggcaaagagagaactgtgcacagcggggaggctctccaagccagagnctcgcacgcagctgaggaatgacgcaggggcctgcaggaagctcacgcggagacaggtctgtggggccccgcgtcagaacccacttcacatcccaaaagncccanctgcttttgatctttcaatgntggggttc

SEQ ID NO: 2698 - DNA, 456 bp, Homo sapiens
  Genbank Accession No. N78850
  unsure (1)..(456): n = a or c or g or t
aggaataattctcttctttattactgtttacttgtagggggaaaaaccattttcatttaagaaagtccttggtgaagtagtaaaaatatgaattttattaaatctcagccttgagtacaagtcttgtcgttgactgtacttacaagttttgtcctccccaaagcatatggcgtcaaggctgggctaacccagtctcatgaccttgtgaatccagtccanaaacacagacagagacacgtgtgaagacggctggccagcgcgaccttgcnaatactcggttggggattctaattcctttcaggacccagcagttgtgggtaaagcaggcaagtgggcccccgtagtcaccctcacaggcccccacacgngaaacaagttccctcagtggcacatctcgctctcccgcacatgtcctcggtgcttgatgttacactcctggttggagatgacattcag

SEQ ID NO: 2699 - DNA, 416 bp, Homo sapiens
  Genbank Accession No. N78902
aatgtacatcatattttttatagaagtgattatatcacaaagaaaaatcctgccaaacaactacaaatcaagaatctgtgggcaaaaagctcaattcatacaatgtaaacacattgaaaaaacaaatgcaaaataaaaaaagctgttgatacatcaccttgaaaaattaacacaactaaattaagggctatagaaaatgtgttcagcttatatatcatacacgtcatttaacttgaattttacaatttttaaactaatagaattcagatttattacttgaaataatggtatacccagctgttcttcataatggcaagcatattccatatacaatacaatttatttagcatagttttatactcttaagtaaaatatgttagtggattaaaagcataaaggaataaatatggcccagc

SEQ ID NO: 2700 - DNA, 423 bp, Homo sapiens
  Genbank Accession No. N79435
aatgattctcttcctttttcacaactgtgcagtcactgtcctattgtgttctattctgaaaaacaaatttttttgaaggtcaagtttttcaatggcacaaaactatttggaatgaacccaaaagatagcggaaagttgggtccctcctcaagtagtttcctcctcttttaacagcatctaactactctctatcaataatctcatcacagccgagttcttcggtcagacgattgacaaccatcagtgaaaaaagctcttcgataaaagctaactgatcaaacggggtcttctcataatgcatctgaaacccgccatccagggctggttctcttgttctcagaaacatcttgtcggcttcttcaagagcggctgatactctgtagccggcaccactgagctgctcctcttcgggatagtcgtagt

SEQ ID NO: 2701 - DNA, 446 bp, Homo sapiens
  Genbank Accession No. N79778
atgttagaaaattttaatatatgattttggtagggccaatacatagtaaagacatagctttatttcaattgaaccgaataaaatgatgtatttcagtaaattaaggcaaaggagatagatgctatgaccagtggtgcaaaatttttcaaaaatttatacattagatttacctttacaaggttatagtcaagaataattaatttgtattttaagcaaactctactgcttttcaaaaaatgtcttaatcttgagtgaggaatagtgaaggtaatcttaatatactgtttaactttaaaaaataattttagaattatagaaaagtttcaaaaagagtatagaatttatgcacacccttctgccagctttccttaatgttaacaatgtacataaccataatatgattttccaaaaccaggaaattaacattacagtagtgttttaatttt

SEQ ID NO: 2702 - DNA, 409 bp, Homo sapiens
  Genbank Accession No. N80129
  unsure (1)..(409): n = a or c or g or t
agtctagatgaatttattgccattcacatatttcatagaaaaaaagatgtagcaaacgggtcagggttgtacaaaaaaaaaaaaaaatccaggtttatataggttgctctatttacatctgagagcacagctgtcctggcatcaggcacagcagctgcacttgtctgacgtccctttgcagatgcagccctgggcacacttggcacagcccacaggnangcanggagcagcagctcttcttgcaggaggtgcatttgcactctttgcatttgcaggagccggcacaggcacaggagccaacaggcgangcaggagcagttggggtccatttcgaggcaaggagaagcaggagttcccgattcaagaggaaaacacgcagcgggacagattctcgtgccgaattcttggc

SEQ ID NO: 2703 - DNA, 286 bp, Homo sapiens
  Genbank Accession No. N80703
tgtttgcaagttactagatcatacaaaaataaccgctacaaattctctgtatctggcatataaaaactgagcaaaaagtatctcttaaagcaaaacatctcagaaaaaaatacaacacaggtttaacttctgcagtactttgttcatataaaacactagtaaaataggcttcttaaaaattaaatagtgaaataccaaccaaattatatacattgttacagtacaagtgaatgaggcaaaatatccagttcttagtttcccaggtgggtgggggtgggcttcagtg

SEQ ID NO: 2704 - DNA, 413 bp, Homo sapiens
  Genbank Accession No. N81025
gttgcttgtgtttttagtgtcatttatttaagaaatcattgcctaattcaaagtcagaaagatttacgccatgttttctttgaagatacttataatattagctcttacatttagatcttaggtcaactttgagttaatttttatatgcaatatgaggtaggagtccaatttcattattttgcatgtggatatccatgtttccaagcatcatttaatgaaaaagactattttgcccccattgaattgtcttagcactattttcaaaagtcagttgatgataaatgtgatcaatatttctggaccctcaattatattggtattttactctttctgatgctgtcaatttttttcttttcttttttgtttttttttgagtcaaggtctaactctgtcatccaggctggattgcagtg

SEQ ID NO: 2705 - DNA, 421 bp, Homo sapiens
  Genbank Accession No. N81036
ctttttaaaccaaagtcaaatgtaggttgttttattgtaaatgtcatcaaaatccagaacagcagaaacatattaatcagtttgaaattttagaaatcctttagcacttgaaaaagagtattacaaatgcatctatatcacatagaaagtcagcgaatacaaactagacaagcaggacatagttcttttctggcattccaggataataagaatatttatcaattaaaaggtcaatatctgtcttcctgaaataactccaaacctgagtcaacacacattcttttcggattggttctgactggcgtaagaagagaaatacagcattttgttttttattttgtttatctaatcacagggaaggataaacaaagggcaaaagtgagagaaaaagttagatgtccttgaatttttttttttagtg

SEQ ID NO: 2706 - DNA, 341 bp, Homo sapiens
  Genbank Accession No. N87590
gtttgattcatagaattccttttagatttctttccagcataccaactagctttagtagtgctgctacaaccagctcttataagtaagagtgaaaaagtattcttttcttctttaaaaaataagtttttcttgcttatagttaattctagaaaggcaatactaaaggtatatatttttttcaaaatgctattttttactgcacttgataattatcctgacagctctgatctctgtaatagattcactcttcagctctgggcagaccagaggcagggttcacaccaaatttgtaaataccatatgtggtctggtgtcaggacttttttcttctgtaaaaaagg

SEQ ID NO: 2707 - DNA, 298 bp, Homo sapiens
  Genbank Accession No. N89302
atccagtgtaaaaaggaagttggaatgggagttggcgggcagtgaacgagtgtggggaaggattggtgctggggcaacaggaaggggccttgggcgtttggctgcactaactttggtagctcagtgtgcatctagagtgggacttgggagggagctaagcttgggctgggctgcttggggcttggcatagggtggaaagggctacctggggctctgaccacactgtagtatgtgtggaggggcctcccgtctcccacaacttctgctataacaataaactgtagaggatcttaaagag

SEQ ID NO: 2708 - DNA, 166 bp, Homo sapiens
  Genbank Accession No. N89670
ccatgagatgcctgccatgacaggcgccacaaacctttcctttattgcaaacatgtcccagtcccgggaggcttgggaagagtgggaaccaggggaacccagggatgggattccactgaaaacaaaccgtcctgctgtcctgtcgagggcccccacccacaggatg

SEQ ID NO: 2709 - DNA, 436 bp, Homo sapiens
  Genbank Accession No. N89738
  unsure (1)..(436): n = a or c or g or t
gaagtatacttccaagcaaaatttattagatgtctattcaagaaaaacacaatgacctttgcttgtaagaattcaaagtcaattacctggaagccaggtatgaatagttttttcttttaaaatcagatacagagagtagaaacagtaatttttcttaaatatgacaggcaacagatattgaagtcttttctcataaatggcatcaaagagaattattcatttatcagcaaagngcatgcagttgacttaatttcaaacctgaagcctttaaaatatgaagctggttatgaacttgacagaaatcaaggtaggctactcaacgatgtttctttaccttcttcctaatggaaattcccttgtcatcagtcagtagatatgtacatttcatttgggcttctacggatctttttaaccttcataggatttttggcataaa

SEQ ID NO: 2710 - DNA, 432 bp, Homo sapiens
  Genbank Accession No. N89937
gcatcagcaagtttatttacaaatgcaattgaacagaaaggctcaccagtttctgaagaagacttctagtatacaaaccatggttatttttcattaatgaaaataagcagctttctattgggaattacttagcaacatttctggtaaagaaaatagagctcccttcatcaagcaaataaatggtacattaactgcatttttaaaaatcagaataataggtagaaggaaggatacagaaagcacatttggggatagattttaatgaaattttccatatggttctgcattaatttagaatacattacaataaacagagcaaatgcaatttatgtatttatattaactatttcaaataatgtttaagaacccttttttaaaaaaccataaaataccctcttcaaaacaccactaactaggaaagtccaactagat

SEQ ID NO: 2711 - DNA, 397 bp, Homo sapiens
  Genbank Accession No. N90238
  unsure (1)..(397): n = a or c or g or t
aagaaaaaacaaagcacaaatataagtttattaatgttagcaaaataaaaagacataagtggcttgttaaaaactaatgtgtaagttttcctgtttccttatctccagagcatttggcattctttatcaactggtacataaaagaatagaaaaataaaagattgtcatattgccctctgtatttctcttttaatatatcagtatggtagtctaccagaaagtagtaaatggcttcaattgnagaaagggaagnnaccgggcttcccttttnganggcgccaaaagcaagtttttcttgttttcaactcaacttgtaacaacccttggaagtcgctcatcagtgaatattttgtttgtttggttccaggtgctatctataaatataatttttttcagt

SEQ ID NO: 2712 - DNA, 418 bp, Homo sapiens
  Genbank Accession No. N90273
atggagactatttcacttttttaatcaaagatggaatattcatcacagttccccaagggattttctaactggcctgggcaaggagttcacttgtagagtgtagttagtgaaaacatccagtggccaagcctcatcaataactgtatccaaaaggagacgctcgcttggggtgtacccagagaaaacaccaagctttcctggcttcccggccctccctctccccattagtctttggggtgcatacataagtgttgtgtgaagtctcttggggtttagaagatcttgcactcattgatggagaagagcctccttctgtttcgtctcctggcctggttgacggcagtttcgggacggcgcactcaaacacctgctgtactccccgattgctaagggctgagcactccaggtagcccttggg

SEQ ID NO: 2713 - DNA, 265 bp, Homo sapiens
  Genbank Accession No. N90584
cgtgttttctggaatttattctcctttatgctgaatataaaatatgtgatttcaccaatgctttaagagacaaacacatacaagttgaaatctgaaaacaataattatatggagcaaagtgcagcctgacacttaacaaaagctgttaaatcgaaaagtatctctagaaaaagcaaaacccctatagtaaaatcaaacacaacagaaagaagctttggtacttttcaataacgggagacaaaaaaaagtttagtttattattaaa

SEQ ID NO: 2714 - DNA, 519 bp, Homo sapiens
  Genbank Accession No. N90820
  unsure (1)..(519): n = a or c or g or t
gattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataatnacttaaataaaagcaggttaanctcaatgatagcagttaaaatgtctaccttatgtattcttttaagtattccattatggtgctctgaccgttcttttggtaaaagaaaaatgccatgggtgc

SEQ ID NO: 2715 - DNA, 208 bp, Homo sapiens
  Genbank Accession No. N91023
atattaaacagtttatttcagtaacattgtaaggcaacaattaatcctcagtaagtcagcaaaccagtgacaagaaattgacaaacactccttctacagcttcctgagacagcaggctggcttgtggccccctgggtggtaacatcttaaggaatcctatcatgtttgtttatatatgctaaactgtaaaaacaaacacttcctgggg

SEQ ID NO: 2716 - DNA, 489 bp, Homo sapiens
  Genbank Accession No. N91087
  unsure (1)..(489): n = a or c or g or t
accgcaagtatgagtatctcatgacccttcatggagtggtaaatgagagcacagtgtnctcgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaanaangaaaagagnnnnaaaagagtgatccagcccttattagggatgtgttttgtgcaatgatgatatgctcctggttttaagtttggcaaagcttatgtatcttttaaatagatgggagcatganctcgaaaggatccttttcccttc

SEQ ID NO: 2717 - DNA, 192 bp, Homo sapiens
  Genbank Accession No. N91273
  unsure (1)..(192): n = a or c or g or t
acagaaaggatgacttttatttccatcctgaatgattcacaccattatttaaacatctgaaaaatcctgaaataatttaaactgaaggcacagaacaaaccaaaatatttaactatcagaactaaaaatcgagaaaatccaaatagttctatagtaacaataaattatgaacaagtttccgtcaacanaata

SEQ ID NO: 2718 - DNA, 150 bp, Homo sapiens
  Genbank Accession No. N91773
tttcacacttcatcttttattttttcttacaaaaggccttcatatcatcgtttgtcttacaaaaaccaaagtccttgtctctgagtttgaaaaacatcttcccagaataaatgggaaaggatctcttataaatatatatatattttaaaa

SEQ ID NO: 2719 - DNA, 135 bp, Homo sapiens
  Genbank Accession No. N91882
tttattttcctgttatctttacatttcttggttttcataagttaaatatacagtattcacagaaattaagctggtggttatgaatcaccaggcagcaacagacagtatacataattatttgacgagtgcatccaa

SEQ ID NO: 2720 - DNA, 410 bp, Homo sapiens
  Genbank Accession No. N92659
tcagattcacaagctttaatcattactttttctgttatacattgaattgtggatgtcctttaattagtaaaacagccactaaaattgtttttatggtttgctatcacaaaagtcgaaggattgctagaatgctgtttacctgtttcaacagctcccatcaactaccgctactcactttacatagaaataaaaacagctactattcattgagcctatttctatatgggaatcttagtgtcctcacacacattaattcactcaattctccccaaactctatgaggtaaactattatgcccattttagagatgaaactgaggtttaaagagattaagtttccaaaaatcagataactaataaggagtagagtgaatctgaatttaagtctcattgcagagagctaaagttctt

SEQ ID NO: 2721 - DNA, 332 bp, Homo sapiens
  Genbank Accession No. N92734
  unsure (1)..(332): n = a or c or g or t
tatctccccattctaccacctatgccagatgttaaagacagcagatgttttgaggagaatggcattgtggagatgcagagatgcgttgctaagttgaggtggatccagtatagagatacctctatttcttctttatggctcaagagagctaggacttggattttgttttacaggcatgaaccactgtgcccagtctatatataatagattttagaagaaatttctgccactcagtgactgctttaaattctagagacagaggctgagagaaacttagtagcctgcctgcgcatactgcaagtacagnctatataacnagttnaaagagaatc

SEQ ID NO: 2722 - DNA, 407 bp, Homo sapiens
  Genbank Accession No. N92775
  unsure (1)..(407): n = a or c or g or t
ttttgccaaatgcataagcttttactgtttttatattaggaaatcatacaggaccaagaaccgctggggtcctggccagccaggcaggccaggatgggctccggggccatggaggcgaagnacagtggcaggcaagggatgaggtggtcacaggtacacgggctgctcctggcctgtaaggaggcgatatgtggcagctggcatcgtcttgatatgcacctcgccatagnctcggtgagcagctcgatgatgcgggcgtgtggcgtggcaccacactctgcccattgatctcaatgatgcggtggccgacgcggatnccccacgctcggcgatgccaccacggaggaggctgcagatctgggggagaaaagaaggggacnggaaaaaagttggggcttctcaagggg

SEQ ID NO: 2723 - DNA, 186 bp, Homo sapiens
  Genbank Accession No. N92915
gttttttttttttttttttttttttttttttaaataattcaaaaactttattgacctataacctgattagaatatgccagatgggaatcaatattgtacagaaagttgtacagaattttttacatagaaaactttacatctgtaccatatacattttgtccatctgaaaaaattttctacatccac

SEQ ID NO: 2724 - DNA, 340 bp, Homo sapiens
  Genbank Accession No. N92934
  unsure (1)..(340): n = a or c or g or t
ttttttttttttttccaagtgttcaggtttactgagagcattaggggcaacaagggagccctggnatctggggacaaggcctggcatttgctggacagtggccctgcaagcagccaaggatggggtctccaccacctggtttacttgaaagtgtggctctcggctccgcccgcccaaagcctttagncncaaacatggatatggctacgtagcaggggtggttgcantagggtttgccttcgtgctcagcgtggcccccagaggtcagcgtcttcccacatttctcgcacttcaggcagggcnaatgccantccttgcccagagaggtcaccctctcggg

SEQ ID NO: 2725 - DNA, 150 bp, Homo sapiens
  Genbank Accession No. N92948
ttttttgaaagtttacttccgagtgtgaagactggctctaaagagtccactatatcaaggtcccacacttcaataacaggggtcatgtttcctacagcaatgtaatttccagtagaatcatctgggctaggatcaaaattcagccattcc

SEQ ID NO: 2726 - DNA, 260 bp, Homo sapiens
  Genbank Accession No. N93000
gttttaaagatattttatttttcaataccagtaatgactgaaaattaaagaattaaagcaggaagcaaaacaaaaacaaacaagaaacccaaaacttgcaacctaaactctccgggaaaaaaaaaattgctataaatgttaaaagacttaaagagaacattgacaatgcagccctgatgtacctaatcatacttcaaactgctggatgttttaagctgagaatctccccagtgcctttctagtgctctaaaatcatctcc

SEQ ID NO: 2727 - DNA, 147 bp, Homo sapiens
  Genbank Accession No. N93105
cagtgtccataaataaagttttattggaatacagccacgttcgttcatgtatgtgttgtctatggctgcttttgcactacaatggcagaattgggtggttgcaacatattttatggcccccagccctaaaatatttactgtttggcc

SEQ ID NO: 2728 - DNA, 285 bp, Homo sapiens
  Genbank Accession No. N93155
tttttttttttttaagaaagactctcttcgtttatttagttgatcccccttctcaattcctaatagtctgacacttattgccatgttttatttaatattttttatttaatcttttaattttaaaaaaaaacccattaacagtacattttggtctaaaatggtccctctgctgaaatgctaggtgctagccgtaattctggctttaaaaccaaaaccccaaatatttaataaataaaaattagaattagttgccattctactccaaaccagctagcctagctgaag

SEQ ID NO: 2729 - DNA, 529 bp, Homo sapiens
  Genbank Accession No. N93191
  unsure (1)..(529): n = a or c or g or t
ttttttgactagaaagggagcactttaatgaacagaagtacagacgtgctggcaaggatggaaatctccactggttcctggcccccttcacctccatgcatccccagcatgggtgttaatcattacccaagctctcgctgttccccctcaccccctgcagagtccagcaggtctagatacgtgctctttgaaatgtgttctgggattaaaaatggtgccctgaggctgtctaaccctcacaaaagacagacacatgcacacacgggccttggggagggctgtgtattagcagtcaggtgggccctcctgggagagcttgctcaagaactcttctcggaaggaaacccaccttaaggtagggttctgataggcagantcccagagggacagccagctgctagaagatggggttatccagggtttgtaaggtttaaacaacgggcagggagncaaacgagtcaaatggtttcctcgtgcgaattttggctcgaggcaaattcctatagtgagngtattaaatcgtaacatg

SEQ ID NO: 2730 - DNA, 184 bp, Homo sapiens
  Genbank Accession No. N93246
ggcatggtcctatttattttcagacattctcgcttcacagaaagaaacagggtgaggggctcaagagagaggctgcccaagggagaagcacgggaacgctgaactggccgaggggcttgtcctcatcctcaggggtagggggaagccccatctgccagtctggtcggaagggaatagatataga

SEQ ID NO: 2731 - DNA, 206 bp, Homo sapiens
  Genbank Accession No. N93299
  unsure (1)..(206): n = a or c or g or t
tttttttttttttttttttttttttttttgacacaaacccactttattcagcattgagccagcccacacgctgggaggtcaaactcacagacatcgcaccaagggccggggactcagaagggctgaaaggcttcatctnggaaatgggcaccgctcacaagcccggctatccccaaatctcaacaactgtctgcatctatgtcccc

SEQ ID NO: 2732 - DNA, 482 bp, Homo sapiens
  Genbank Accession No. N93316
taaacaaagtccaattttattcactctcaatatccttgcagtccattgtataccttctgcactgacccttgtttcagtagctgtttgataccttctctcgcttcctctgttaactgttcttttggaaaatccacatcaaaagtgattatcaaagagcccttgatattgttgttgtcaaagttggggagcccttcccctttcttccatagcttcgctcctggcctggtgatcttatcccgggaaatatgtaccttgtgaccatccaagtgagtaatatccatctcaaagccaaccagtgactcaactaatgagactgtcacatttgtgtacaaatcatctcctctcctttcaaatattgggtgcttgacaactttgattcggaaccgtaaatctccaggctccccatccacgtgaggctcaccttctccaataaaggggtactccatgccgtctctcaccccaggctctatttctacttccag

SEQ ID NO: 2733 - DNA, 499 bp, Homo sapiens
  Genbank Accession No. N93403
  unsure (1)..(499): n = a or c or g or t
tactcttcacttttctttttattattcaaaagtcaaatgtttttaaatcatccatcctcaattttgatttaatgtaccgtcatttccccaagaaaagaaatttcagaatctctttggaatactaatttcatgtttctagatttaaccaaactggtgaaggtttnaattccatcnaatttcccggaatctcaagacagttgntgatggtaaattttaatntaaaatatttaggcnccaaatagnattgcntttggtatggccatagntgnganggtaanatttgcnttgcntttggcaataaaaaacctatacccatcctttcataaaactctaaaccaaattaagaactgtggatggtaggaacaaaaatttacncntgggtaaaacaggtaccagcacaacggttaggttatattacatcaaaaaaagttttaatgggtcccaaatatatatactcaacaactaagcatacactcnggggaggaaaaaaaaaatcnaa

SEQ ID NO: 2734 - DNA, 170 bp, Homo sapiens
  Genbank Accession No. N93465
ttttggtacaaaaggtgtctttattgaggtctgggttaaaattaggcacttggccacgagcagcagcttaaatatgaggcaagcagtcaggggttagccatgcctggggtgggttggggtcatgaggctacaggcacagactgtccccaggtggacagaagtttggagca

SEQ ID NO: 2735 - DNA, 234 bp, Homo sapiens
  Genbank Accession No. N93470
  unsure (1)..(234): n = a or c or g or t
gaatatgaagtgtttttattttgctaaatcttcacaagttttgttttgtaggtgaggaagctgaggcccagagcatttaaacaatttgtccacggttatacagcaagtaactggcagagactgggatctgcagtctgacccctgacacatgttcaaccgatgtcagagtttatttattacctctgttgttcacaggaagaaactaggggtatcttaaaatcttctgacatctnc

SEQ ID NO: 2736 - DNA, 468 bp, Homo sapiens
  Genbank Accession No. N93764
tttgcataggcattactagggacataaatgggagactggcatagaaagtggtgaggagccgaagccaaggaattgctttaaacacaagatgaaaatactctgttctgtccaaagcatcacctaatggtgtgaggcatctcacttagctgtggagaagtccttggaattagatctcagaaagacagctttaagacagtaaaaccttttggcaatgggctaattgccttaaaagaagagttctacctgaaagaccttgcaggtggagaaattgtcctacaaagattcttggatatgttagtggagataactgacatgggtagctgtgggtcaaccaggaactgtcaacaacctgatctctgcaaaaccaggatggccagttaatggtttattcagttctctgatggtcacaaatgtaattttatttagccttgtggagggttctgcaacaaatgtaattttaaaggaatt

SEQ ID NO: 2737 - DNA, 270 bp, Homo sapiens
  Genbank Accession No. N93798
  unsure (1)..(270): n = a or c or g or t
cacggctcctgttttattgccttcgggtgtccggagcacctgactgccccggggtctaataatttaaggtgccgagaacaggtcaggacaaggggtcgcaaaanaggggctgggggcagntggttacaaaatatacccccaccccacaacaaacaggctagaggagaccagcctggctgtgtcggganggggcgggcagagggcgcccgaccagccttcagagagacagagccacggccagcgccccagagggagtggcggagacaggac

SEQ ID NO: 2738 - DNA, 457 bp, Homo sapiens
  Genbank Accession No. N94146
  unsure (1)..(457): n = a or c or g or t
aatgtgcaccaaattagcagtaaaaatagcagcagatggatcagagtggttgtcaataaaccttttctccccaggttactaatatacaattgccatgaaaaataaaaaaatatatatatatatttacacttgactcatcacctctgcttaggaccctgtaagcacaagatattgctgaactgctgtatttgctacatatggaacaattagactagcaataagaagtagtttatgcatgtatgctggcctacatgtatatacccctttcgcaattactgaggattatcaacaaagtttggtcttgtcttgtgattataattctattaaattacatttaaatgtgatatacagaattttggttttataattagtattattctaagaaataatagtaatatagacccngtaaaaataaccataacttatggcaaaagcaaattcagaaaatggcaataat

SEQ ID NO: 2739 - DNA, 441 bp, Homo sapiens
  Genbank Accession No. N94367
ttttttttttgtttcaaccacaagtatttattgatggatcgaagatacaattttaatggaacaataaggcacaaccgtggattaaaacactttgctatacagccaaaaggggggaaaatctataaccttaggaactttatgccaatcaagaagcctctaaagtacctctctaatagatcagtatcagacattcttcccttttacataattcctatattacatcacttaatcataaaatctgactgatacttcataaagaattcctcattcatttatatttgagccatccagcctggctactcccctgttctccacccttttccatcactttgcagtggtattttttagcaatcttcaatagttttccaaagcaaggaaacaagcaagcaagcaatgagtcagaaagtcaaccaagggcagatgtgtgggctaaatacactc

SEQ ID NO: 2740 - DNA, 409 bp, Homo sapiens
  Genbank Accession No. N94930
atttgtgcaccactgaaaattcttatttattcactttaattctgcatttacacaaaaatgctgtaataaaatatctgtacactacttctgttacaaatatagatatttaaagtgactttatatattctaatgtaggagtttcacgctctaaaatgggaatgaacacatgataattcctcaccagttgtctcaataaacagctccatctgtttcccttagtcttaaactattgtattataagatgttaatataaggcaatgaaatgaagttatgttaatccccttaatttttctatcaatttactaatggcatacaaccaaaataattagtaacacattgttctctgtcattaagattaatatgaattgaaaaccaattgcacagcacactaacacatttttaatgttgc

SEQ ID NO: 2741 - DNA, 462 bp, Homo sapiens
  Genbank Accession No. N95495
  unsure (1)..(462): n = a or c or g or t
tttttgccaaacattagagtttgttttattgcatgacgtttgcataagaaaaaaagttattgaaaactgtaaggcatcatgcaatcattgaataagctaattattaactgtacacttaagataggtggacatataatctaaaatttaaaaactagttccagaaaagtacataaaaaatttaacatgatgagcttttaaatatggtttatagtttcatgttgttaaaaagtgcttcaaatgtactgctggaaagttgctctttacaaatggcgctggggtgatgtcagattataaactgtaaaaaccaagtacttttatggaattagaaagctaacattgtgatccccaacttcttgaaccagttttcaatccccattcaaattaagttgattaatattaataactaaaaacactggtttatacccccaaaggcttggatccagtagnctgtggccaccaatc

SEQ ID NO: 2742 - DNA, 394 bp, Homo sapiens
  Genbank Accession No. N95585
tcctgagaagtcactggtgtttaatggaaaggtatcctattagtccttggttaagataaggcagtaagagtatcactaatactatgtttttgcttagaatgaggctgatccttccactggcgtcttcacgggcaattagttccctctcttttgctcctagaaacacaggtaggagctgtctgccccctattgctgttgcattttctgagtgtgttgaaggctcatctagtctcatcacagcagcttccccagtgggatggagcgctgtatattgcattgtagcatctctccaggaagtgcacgggccccacagaggaaaacacaggcatctttctttctgactcctcttctgttctcttagggacggggcccataaatgattccttcacatgat

SEQ ID NO: 2743 - DNA, 439 bp, Homo sapiens
  Genbank Accession No. N98464
tttttgatttaaaagattttattttctttatgcaggtaggcagttagaaatttcaaagtctaacaatgacattcttgaagtgggcacagcttttaaactcaggctatgtatacagtaaccttgtggaactggttcagccagatcttcactttcatgaaagcacagggtctgtccttttctttccagagggctcctctcatattccatcgccagtttctgttacaaggcagactgaatcaagccaagatcaacacacactggtacacgtggctcccaaccaattttatatgtatatatatattctacttccaacacccgcattcatcctggttcaatcaaagcctggttttggccaacaataaactcgtcaggagatcgaaggttgtagatgtctgcacgtggcttccttggaggtccagtggtgactccctcttccaaa

SEQ ID NO: 2744 - DNA, 509 bp, Homo sapiens
  Genbank Accession No. N98758
  unsure (1)..(509): n = a or c or g or t
tttttccaattaaatcttttctttttttttatgaaaaaagatcacacagaatttgccaacaaacaaaattccaaaagaaacataaaaaaaaaaaccaataattcccccaaaaaacaaacccaaagtctggcttttccttccctcaagattgtctggttgaggccttggtttcccttgaaggcttggggcctggttaagtgctttctggggcccaagcagggaccctcgggcttgggcgggctcctgcctctccctcttctctccctaacaaacacttctctatcctggggggtgagtacagtacacttggtggggtgggcggggggtgtgctgggggactgggaggccggtgaagccgttngctagacactataatctaacaggaaataaaaaataatattctggcacgtcagaatgtttttttttataatttcatagctatttttcacagttttaaaaagtttatatatatatttatatatatttanccttatatatataattaanaa

SEQ ID NO: 2745 - DNA, 462 bp, Homo sapiens
  Genbank Accession No. N99505
agtgtggctataggcttctaacgaagggaaatgaaatatagggctgtctcctgctttataacatctggcttacaatcaacaaatacaaatagggtcgcttggtgcagcaaaccactatggcacatgtttacctgtgtaacaaatctgcacatcctgcacatgtatcctggaacttaaaataaaacaaaacaaatagggtctcttgccctgtgggaactgaagccactgctctgtaggaaataaaagtgtctttcttttttgttttttttttgagacagaatctcgctattttgccgagtgaagtggcatgatcttggctcactgaagcctcccccccgacaaggtttcaagcgattctcctgcctcagctactcaggaggctgaggttgagagaatcacttgaacctgggaggcagaggttgccgtgagctgagatcgcaccagtgcactccagcctgggca

SEQ ID NO: 2746 - DNA, 487 bp, Homo sapiens
  Genbank Accession No. N99542
  unsure (1)..(478): n = a or c or g or t
ggaattcaggagctgcagataagggccctgcaggtactatgtgctcagtaaatgccagtggttcttaagggtctgagctcccatggtagaggcaagtaagctgaggttcagagacagaaaatgacttgcccaagatcacccagctgggaagtgacagtgccagggttggagccctggttgagctggttccacaggccagagctcattctgccctctccccggaagacctcccaccctgtccccatgcctctgcttctccctcaccccaattccccgctgccttctaggataagtgtgagccactggangaagcagcacgagaaggagaggaaacaggaggagggggaatcctaagcaggacacagccttggatcaggacagagacttgggggccatccttgccctccaaccccgacatgtgtanctcagctttttccctcacttgcatcaataaagcttctgtgtttggaacagctaaaaaaaaaaa

SEQ ID NO: 2747 - DNA, 399 bp, Homo sapiens
  Genbank Accession No. N99866
ttttttttttgggggaaaacacaccacttttatttttatgcagcattttcaaatatgcatgtcaatatatattttataaactatttaaaataaaaacccttcatcctttgaggttattgacattttctagttcactgacacatctcccataatacaatagttctattcattttcatgaatgaggtgggaactacactaaaaagtaggattttaatccctgaggtgccagttaaaatggacgaggttgcccttgcaacacaagattttaaaaatcagccttaaataataagcatggatcatgctatttgaatcagaatcacctccatagcatgaagtcatttaggaaattgcatttattgggttaagttcacctgctattcccagcctcatgctataatg

SEQ ID NO: 2748 - DNA, 459 bp, Homo sapiens
  Genbank Accession No. N99944
  unsure (1)..(459): n = a or c or g or t
tttttctttttacttttttttttgcccgcccctggcagagctcttggcggggagggaaggggagagggaaatataaccctgaggtggggatggttcagctcccaaccccggaacccctggtgtgtacgggtcaggcagacacatgtggctgggcggctgggctggggaggggncagccgccactgaccagcagaggtnggaagttcggtgcgtttcagtgcctgcctgaaagcttggggacaggagggctgtccacaggtggtgccccccgcggccctggcgcttctcctgtggggcccgcatgaccctctgctcgggcttgggaagaaatggagcctaccaggtgctgggttnaacccgctgccggtgtggacccaagntagattangcacccttgcttctgcctttattttattatttgagnagagttcnccttaatgccagctgaatnaatgtcga

SEQ ID NO: 2749 - DNA, 338 bp, Homo sapiens
  Genbank Accession No. R00296
atcgtttttatgggaacctgcagggtgacccggcaccttgctaactgggcttagagtctaagggcttgggggctgcatctgatacaggttggagtttggggtgggagagtcctaggaagggggccccaagtagaaatgagagaaatcaggaagggatatcgggggcgtccacgggggtgctccgactggccttgcacccgtaccccagctctgcaccccccgtcacgagcagttcaatgcccgtgcagaagttggcttcggaggccagggaacactgccgcagccccgacctcagcgggctggcccatgcggcccagtggctggccagcattgccctc

SEQ ID NO: 2750 - DNA, 309 bp, Homo sapiens
  Genbank Accession No. R00843
  unsure (1)..(309): n = a or c or g or t
ttttaatcgttgtgattttttattagttctcataatcgcctcttattaatttgtatgcacataataagcactcaccttcacagtctgtccggcttcggggccatcctgcatggaaaaggtgagagaggtcccatggaaatgtttttccaccactgtcccgactctctgggtcgtctgaaacaaatcggccacttcatcaggacgcaggtcatgggaagcgctccactggccgcagcgggcacacaaggacatgtcnggggtaccacagggtttccctatttcacaaggagncgaggganaattnttttt

SEQ ID NO: 2751 - DNA, 336 bp, Homo sapiens
  Genbank Accession No. R01023
  unsure (1)..(336): n = a or c or g or t
gtngttccaaaataagacatttcattttatttctgaaatcagaataagtcggtgagagtagaaaccactaggtcgagagcaagaactctcccccaaagtggagagaatatttctccctaccctgggctgcggatccctggaaatggggcttcttcctcccacatgttctgctggcacaagtccccttgggcgggctgggctgaagtgggcagggttgggcccctttcacccacccagaaacatgggttcacttgaacgtcaggctctaggatcttcgagggggtccccagtncgctttntgacctgggcccagcaagagcacttcctgacaaccct

SEQ ID NO: 2752 - DNA, 373 bp, Homo sapiens
  Genbank Accession No. R01081
  unsure (1)..(373): n = a or c or g or t
cattttattagaaaaacgacggctctcaagaagccctgccccacagaccccaccctcatctcgtgggccaggactaggccaacagtccctcctaacagcaaggaaggctggagaatcaggtggttttatttaccctatattgctgcccacacaaaactaggcttttgttcacaagggaaaggggagaatggctgctggggaggagatgcggagtgcagggagggtggggaccaagaacccggcttggtcctgggagagggcagtggcctgccccttctccaatccaccgacatgtggggtgtctggttttctntngccctcagaggcccacccacagactctttctcatttctctnttttaggatgagttatc

SEQ ID NO: 2753 - DNA, 256 bp, Homo sapiens
  Genbank Accession No. R02036
  unsure (1)..(256): n = a or c or g or t
nnttaaattattttattcaagaagtgggggaggacagacaaggggactgagctgagccctgagtccctgaacctcccagctcagcccccacagcaggactggactcaaagtcagagggtggagactccagccccacccagacacggttggggacagacaggacccagggaataccngactgactgtcctccagggggatggcggccgagcacanagggcccggccttgggaccccccngggtgggctatttttggg

SEQ ID NO: 2754 - DNA, 291 bp, Homo sapiens
  Genbank Accession No. R02365
  unsure (1)..(291): n = a or c or g or t
ttttttttttttttttttttaccccactaaccatctattaattatacttaagctggncccccattactgagagtgcattactatataattaaagccatttagacanggcttggcatagcacttgcatganacgccacatactaaaaactcctccttagggcagccttcttttcctatcagattcagagctcctttctccttttctcgggnaaaaatgaacacagggagggaaaattctcagtaggggntctccagcctgggggggcttgtgagctgggccctactgggggg

SEQ ID NO: 2755 - DNA, 378 bp, Homo sapiens
  Genbank Accession No. R02371
  unsure (1)..(378): n = a or c or g or t
tggtgtctgtttgatgtttattggtgggtgtctgatgagcgtttctcttgtccagactgtgtttctctctccagaccagctcccaggggtacagggggtggggagtaggtggtagctgtgtcagtgctgggccctgggtgccactccctgaggccaagaccagcatgggctttgatggagccaccccaggggaagccccaagagagatgaagccatcaataaagcggtccttcangggcttggggctttggcacaacaaggaaataggagcaagtttaagacaacccaggtttttggcccaattagggaagacaagnttttccattaggcagcnttcatttttctttcaccaacccttcgagttttcgggtaagtant

SEQ ID NO: 2756 - DNA, 366 bp, Homo sapiens
  Genbank Accession No. R02572
  unsure (1)..(366): n = a or c or g or t
ttttgagagctgatgacagacaacagcaagctactttacagaatctaccaactgggtaggaaagtcttctgagtttctttgcagacaagaaaagttacctgttgattgttggccaatcaataagggactttcctctctgccattaagagcaacgatgctgaccacatactctgtgcctggagtgaggttggtgagggtgatggaattccgagagtggggcacccgatcttctcgaggtctcccactgaagtgctcgggatgatggcggatcctgtagccagtgatggtggctcgaggagcaatccagtgcacagtaaaagagttggcagtaatatccagaaaagtcaatacccatttggggantca

SEQ ID NO: 2757 - DNA, 414 bp, Homo sapiens
  Genbank Accession No. R02752
  unsure (1)..(414): n = a or c or g or t
aaagtgcctttatgagtatgtgtgtacacaaacacagccccagaggttttccaagtgtactaaaactcgagattttaagtctttcctcgcatgacagccataggtgaggaaccaggaaacatactaacactaagcaggagtcacgtggccaggccagaacagaaagcagagcatggaagaaacctaaatgcagttaagaagttttacccaaaagggtctattaagccacctgtcacatggccacccaaacaaagttcctacttatacttcagcacctgttcccaatgcttgccaattccccatcttgcggggtgggtgggtatgggtcagtcttgaggcattatttaaacaggaatttaattagcccaaaggggaaaatgagggatttaggatttctncctaatgccccaactt

SEQ ID NO: 2758 - DNA, 428 bp, Homo sapiens
  Genbank Accession No. R05309
  unsure (1)..(428): n = a or c or g or t
ttttnatntccttaaatgaggagatttaatgtctttacattatacatttcaaaggaacaaaacaccctttatgaattttctcatggagatagcatttacatcacagagctattgtgaaaataaaataagantgtacagcacacctgggantataaaaaacatcccantaacttacttgggngccccgcagccatccatccctcacatataantacantgaaccagatgaaggatccgtgtccgtgtccatgacaggcantccattcaggaggntccaaaggntaaataggtcttaattcacccantttctggacatttgcttgggcactgcgggggctcatggagggggcttgccccttcatatttntcctcattttaatnccctnccaaccanaaccggggctcggggggggtngggtccttgccgg

SEQ ID NO: 2759 - DNA, 416 bp, Homo sapiens
  Genbank Accession No. R05316
  unsure (1)..(416): n = a or c or g or t
tgttagaaatgacttttgttttgttttatttttcatggggctttgtctgtttcttgccatgagtagcaaaccagtgtacaaaaatgtcacagacgagagcaacaagcgactaggttttcctgagcccaaatcagctcactctatatacacaaaaggagggctgcctccctgtcactgactctacccgccacaaagcgggcagggatggggcagtgggggggagctccttcccagcctgggggcctttgccaagggagcccacaagggcnttgcagggaggaccctccattaatcagcgtcagtgtcttgtcttaacagcatcacacatgggtcctttttttcctcctnccctacctncccttcagtaggaaaccaggtagggaaaatcctnttcagggaggggggacagaggggct

SEQ ID NO: 2760 - DNA, 452 bp, Homo sapiens
  Genbank Accession No. R05490
  unsure (1)..(452): n = a or c or g or t
ttcaattttattctacttcacttacaaatctgctgctgaacatgaagcaaaaattcatagtaagaaaatgcagcctctgtccggtcttcaatcaaatgctgaaaaaattctgctttggcaggactctcatcttttactatgtgaaggattggacttaatggtctgctgtctctaagccaagttatgaaggatctggctctttctgatgaaagtgtatctagctctggaagatgtgtcattttctgtgggtattgatgcaaaattaggtatatccaagcacatcctctatggaaggttattgtcacagcctttccccaaccccaaatgtaaaaaacagagccacagtcccatagggaaagcacccttctcttggtcagcttctctggcaggacaatttttgagggggtggccttggggaccaatcccgtccattaacctggactgcacccccn

SEQ ID NO: 2761 - DNA, 462 bp, Homo sapiens
  Genbank Accession No. R05518
  unsure (1)..(462): n = a or c or g or t
agggaaaaggtttatttggctcacgattctgatgtctgagcatctgctgaggcctcaggntgcttctgctcatggtggaaggcagaagcgagtcggcataggcagatatcacatggtgagagaggaagcaagacagtggggggaggtgccaggtgccaagctcttaaacaatcagctctcacaggaactattacagtgaggatgtactcactcgccagggaggacattaatctattcatgagggatccngtcctcatgacccaaacacctcccattaggccacacccccaacactggggatcaaatttcaacctgagggaggccagggcaggcaccatggctcatgcctngttaatccccaacactttcgggaaggcttgaagcggggaagatggctttnagcccccagcatttcaaggcttgcagttnagcttggagttncacccactgcattccagcctt

SEQ ID NO: 2762 - DNA, 351 bp, Homo sapiens
  Genbank Accession No. R06002
  unsure (1)..(351): n = a or c or g or t
ttttttttttcagaatgaaaacacttacaaatcatttttattatgaataatttaggatatttgggacattcatttctgagtaaaatagttcaaaataggattttgttgataccngttgatacatatttagaaacaaaaatgagatatccttttgaaagtttgcctttgtagtaaattcagtcattcaaattgttttctctcaagacccaaaaatgccnggggcattgccggctttgagtttattctttgtttcttcatcaaattcttccatgggnctctattagtttcccnggggtccagctcacctagtgggaaagggggnaatcgggntccccaaaatgactttatcct

SEQ ID NO: 2763 - DNA, 391 bp, Homo sapiens
  Genbank Accession No. R06251
  unsure (1)..(391): n = a or c or g or t
tttttaanttttttccccaaaggaatgctttattgacaaattacccattattataataactttaaggaaaagatacatcggtcaacacccgcacaacctgccttctcaccacaccccacaggccgnttttaaccctgggncgaagggcaccgagcgntgggnttccctggcccctgcatctctgtcgtgtgtgggagtgccatccccaagggtgtntgaactgtccggggacacggctgtcagaggacanttgctntaccgaacagggacaccttgagntgaggcagccctttcccntcccggggagtgggcagagcnggggcacaccacagggcagggnccttcaggtnttccttgccaagaggccatttaaggggnacagagtttnccc

SEQ ID NO: 2764 - DNA, 209 bp, Homo sapiens
  Genbank Accession No. R06254
  unsure (1)..(209): n = a or c or g or t
ttttttttttttttccccaaaggaatgctttattgacaaattacccattattataataactttaaggaaaagatacatcggtcaacacccgcacaacctgccttctcaccacaccccacaggccgnttttaaccctggncgaagggcaccgagcgntgggnttccctggcccctgcatntntgtcgtgtgtggagtgccatccccaagg

SEQ ID NO: 2765 - DNA, 426 bp, Homo sapiens
  Genbank Accession No. R06271
  unsure (1)..(426): n = a or c or g or t
tttttttttttaaagtaacatttaatgaatacacatttataaaagccatcatcccttaacatggggaaagtgtacaaaaataatgtgaaagtgtaaaaatttttctagaatacaggaaacatatcagcagtaaagaagtttagtttaactttttttttaaatgtaaaatagtttggnnctgttaaangggnntacagttcgcccaaagcacttattttcatctgttgtaaactcattctttctaccttanggtaactgggngggagtcngctgtgttaatatggggccaaatttaatttcntaggttttgggggagcnggggagggttgtggggggaagggnccaggaaggggaggnccttgggggcctttcctttggggccgctgggtgggggggccttnggggccccttgtggggttggggggc

SEQ ID NO: 2766 - DNA, 344 bp, Homo sapiens
  Genbank Accession No. R06273
  unsure (1)..(344): n = a or c or g or t
tgtagagatggggtcttattatgttgcccaggttggtctcgaattcatgggctcaagcgatcctcctgcctcggcctcccaaaatgctgggatttgaagcataagccaccacgcccagcgataaatctcttttctttaaaattatccattatccaatctgtggttacagcaacagaaaatagactaagacaagaggtaaaggaaaggaggcagggaagtaggcaggagggcaggaaagantgaaggaaagggaaacgaagagaggcaggggaaggaaggggtntggacaggggaggtngggaaagggaagggnaagttnagggaagggaggccaaggnaggcca

SEQ ID NO: 2767 - DNA, 353 bp, Homo sapiens
  Genbank Accession No. R06400
  unsure (1)..(353): n = a or c or g or t
tcgcatcttctctagagtcccgcggctcacagctttgctgcgaagggcaacttgtgggcaacctggtcaaggaaaccttgcacttcttcaaattcacaacgcccacccatctctacaacaaggcggccagcttcacaggtgtcacgtagtggtcaatagcacctttgcctccccccatgcgatgcccaacanttttgcgagtgatgggcttgaaaggggctggtactcgccatatggcaaacatgttcttggggtccatagagcggttgattgtcaggcgcatcatttcaaagtggccccaatgcaggtagccaccacccaatgccaagattncaaanttgcctttctngtaa

SEQ ID NO: 2768 - DNA, 417 bp, Homo sapiens
  Genbank Accession No. R06543
  unsure (1)..(417): n = a or c or g or t
tttgctaggtgaaagtgctaaaaactctcaatttcatcaagattgacaagcacaccaggcatagtggctcacacctgtactcccagcactttgggaagccaaggtggatcgcttgagtctgggagttcaagaccagactgagcaaaaaaaaccagaccagcctgagcagcccgaacagggatagcctgcctttacagaaaaatttaaaanttagccagggcatgggtggcacatgcatgcctgtagtcccagctacatgctgagatggggagggccactttgagccagggcggttgaggcttaccaaagagggantgatccacaccacttgcacttntagncttggggcnaacggantaaagggcccttttttttcccaaaaaggnaaaaaggaatttccngaattttaattctttt

SEQ ID NO: 2769 - DNA, 362 bp, Homo sapiens
  Genbank Accession No. R06726
  unsure (1)..(362): n = a or c or g or t
tttttccagctcaacccttctttaatgtcatccagggaggggncanggnttggaggggaggggttgaggagcgngaggangttatttttgggtggnnttaccacttttcccatgaagaggggaaacttggtattttgttcaatcattaagaagacaaagggtttnttgaacttgacctcgggggggatagacatgggtatggcctctaaaaacatggccccagcagcttcagtccctttctcgtcgatggtcaagcacaaccttattgcacggcttggangagcttcaggggtgctcctctgtgaccccggagaggtcaagccccattnctgaagaccttagtgatgcccagttgacccagg

SEQ ID NO: 2770 - DNA, 249 bp, Homo sapiens
  Genbank Accession No. R06746
  unsure (1)..(249): n = a or c or g or t
taattaaagatcttnnaaattttttttttttttaaaaagcgacnaanacatttattgagagctgtaaaatgtgtttcacccaattgtaatgtaaagaatcgaaaattttaaaaaatttccaaaaaaattacatgattgtagttggtaaaaatgcacccatttcagganggcccctgtgcctgtgtataaatgatgtgtcttgaacgctgctgggaagctctattgctgagattgagaagaccttagaaa

SEQ ID NO: 2771 - DNA, 589 bp, Homo sapiens
  Genbank Accession No. R06764
  unsure (1)..(589): n = a or c or g or t
cgcttaattaaagatctttttttttttttttttttaagaattcaagggctttattggggagtctagtagagttaggtcagccagagttcgtccagtaagctccacgccaattttatctttagtgttgtaagcatccaagtcctggctgtattcattgttgttaaattgggtcttgagtttccaggtgcctgtctgctcagctggagtaagcagggcactgactttgtgttcaagagctgcactgatgcttttcctagacacgagatgatgacttgtggagcctttgtaatcatgagagaaagtaaatgccagaggttctgctttcaacaggaatttgctatacagctgcccagtatgttctccccagagagcgagtttcccattgccatttgtatgtgcatcgatgggtcatgggtaaacggggccatttacagaacggaagacatttgttgaaatgcagtgagtctgaatttttagtttgtggntcatgttcaatggcttgaagccagcccagcgatgtcttgttnttgagnccatgntaaaacttccacancctgnaccttaggcaccagngtcttgntttataggt

SEQ ID NO: 2772 - DNA, 402 bp, Homo sapiens
  Genbank Accession No. R06860
  unsure (1)..(402): n = a or c or g or t
nnctttaattaaaggntctttntccnnttttgttttggaaantctttctttacagacagggtctgggctatatcgtccaggctggactcaaactcctgggctcaagcaatcctcctgctcaacctcccgagtagctggcactacaggtgccaccacaccaggcttgattgtgacttgactgtcacccagtgtcacatgagggcaagtgtggaattttccatttgtggggtcacgtcagtactcaaaaaaattcgaattttagagcattttggatttcagattagggaatgtttaacctaagtttgtaaagggaaattttttaggccttaggaataggggatgtttcaggattgtttcaaggaggacaaatgaaaggactaaaacaaccnggaaaacattggg

SEQ ID NO: 2773 - DNA, 303 bp, Homo sapiens
  Genbank Accession No. R06866
gaataagacttggagccgctttaattaaagacttttttttttttttttttttttaaacattagatctctaattttaatagttgagaggaaggttataaaataaaacagacaacacagagcttcatgacggcctcggattggcagtcaacccagggatacagaaatgtaaacaaaaacagagcttccagataacattactgtgtgctatgtgactttcagaatacagcagcgtcccagacactctaaagtcaagtgaaacaagagattttagaatcaatctatacacatttcagagggcagtcc

SEQ ID NO: 2774 - DNA, 320 bp, Homo sapiens
  Genbank Accession No. R06977
  unsure (1)..(320): n = a or c or g or t
atttcattttatttctgaaatcaanataaagtcggtgaagngaanaaccactaggtcagngagcaaaaactctcccccaaaagtggagagaatatttctccctaccctgggctgcggatccctggaaatggggcttcttcctcccacatgttctgctggcacaagtccccttggcgggctgggctgaagtgggcagggttgggcccctttcacccacccagaaacatgggttcactgaacgtcaggctctaggatctcgagggggtccgcagtcgctttcttacctgggccagcaagagcacttcctnacagcctnacaa

SEQ ID NO: 2775 - DNA, 319 bp, Homo sapiens
  Genbank Accession No. R06986
  unsure (1)..(319): n = a or c or g or t
ngtaacttaagcaaaaaangggtatttaattggttcacataacttgaaaagtccaggggttattctagcttcaaggcacggttggatccaggggcacaaacgctgtcatcaggattcaagtctctccatattttggctctnctttccccngcactggcttcattctctacatggnaggccctgttagtttgaggttttcancctacaaagctaaagcaccctcaggaaaagngagcttctccntccacaagntcagatggggtttgctgattgatgaggnctgaattacatgttcacccacaaanctcaaaggtttggg

SEQ ID NO: 2776 - DNA, 330 bp, Homo sapiens
  Genbank Accession No. R07172
  unsure (1)..(330): n = a or c or g or t
ttttaaagaatacggcacttttaataggcggcagccccaggnggtgcgtggacagaccctgtccacagcgcctggctcccgtgctgcctgtccttccatctggaatgccaaacagaagctcctctcaggtggcatctggggagtaggtcccagtcctgaaatatacaaagtggcgcctcccactgggcagtggtcactgggctgcacggtcctttcaagtcctagggtggcccctcaggtcactgcttggccttcttcacaatgggtgcccacagcagagatgacggtggtcttnggagccgctgggcttgggtgggtgaccgtgacaac

SEQ ID NO: 2777 - DNA, 353 bp, Homo sapiens
  Genbank Accession No. R07637
  unsure (1)..(353): n = a or c or g or t
ttttttattaaaacatatacgaaaaacagaaaggaatacatagctgatttttaaaagctgtaacagaaaggcaggattatgcattttttattcaaacatacctataaaantattatttttacatttgaaaaaatattaaatttttaaataattacctttttgtctcgactcccagtgaagaaatacttgctgtcaggactccaatcacaagaccaaataattctactgtgcacagaagtaattttgttggtgaaggcaaaaaggctaaaaactggctctganaggnatntgtatacactnttcaccnagccgaggaaagctggggnttttncccggttaggggaggtgntgtt

SEQ ID NO: 2778 - DNA, 328 bp, Homo sapiens
  Genbank Accession No. R08548
ttttaaaacaatttccgctttattccctccttgatgctttttataaataaggtttaatagaaagcatcactattttttatttacttctacagggggaagtagctcttttcctggcaggggtggacacgtagttatgggatgagctcggtggtactcggcctgtccacacgagcgtctctggctttgtcgatatgcttgacaaggaggggaagagacaagagtacgaggcggactcccagtatggccagaactactcctagtaaggttttaaatcccccgagggacgaaaaccaaccacgggggggggcggggggaacctgggggaccc

SEQ ID NO: 2779 - DNA, 422 bp, Homo sapiens
  Genbank Accession No. R08564
  unsure (1)..(422): n = a or c or g or t
ttcanaaatcatttttatattttatttactattttgctccacaatttgagtcaaacatgtgatgagagttctaacttgatatgtttacttcagtcccaaacatagtcatctttggtcttttctcagatttggcctaaaactcgtagtttcattgatttttttttttaactagggcattcttctatgttctagggtcttcaagaaacctccatacccanggaaaaaatnggaanggcaaccatgttctactatgggtgccaaaaataggttgaacatcgacatcaaaanggattctttctggtctggcttattcacatattctgggtttggaattaaaaggtgatggaanttatcctaaatacggtggggccctctggtatcctgggggttccncatccacaantttcaaccaacgtggggtg

SEQ ID NO: 2780 - DNA, 374 bp, Homo sapiens
  Genbank Accession No. R08615
  unsure (1)..(374): n = a or c or g or t
acaccagcaagtttattgagtaattaaggtgacagccatagaactttgcaaatgcgtttccataaaagttctgagttacttgactatgaaaagtgaattttcattttaaccaaccccctcctccaatactaccagaaagcatgagattctgaagaaatcttcacaaatctactcttaattatgggtagcaatgttccagtctcaattagggttctgctggggttctgggagttggggagtgaagtgggctcttgagtgggctnccagcacttgtggggaggttctcatcccaaacactggggagggccttgaggtcccccactttgtgacccgccaggactttaaaggatggattccaaacataaatgnccatg

SEQ ID NO: 2781 - DNA, 294 bp, Homo sapiens
  Genbank Accession No. R08850
  unsure (1)..(294): n = a or c or g or t
ttccnaaancaggcagttaatgtgctgacatagtaacaaggtttgaaggaggaacatctcatgcacgtgcgtggaaacccaattgtcatgtgtatgaactacaaaaggatggggaaaagaacacatttcctcacaacaggantacatgagattagaaagaaaaccggantgaggtagatgcatgantgcacagacaaggntatgtgacaggaagctgggtgacattttgcatctgacatagcagtacacctagagagcccaaggaantccacccccaagttaccagaggcaaga

SEQ ID NO: 2782 - DNA, 348 bp, Homo sapiens
  Genbank Accession No. R09053
  unsure (1)..(348): n = a or c or g or t
ttnanatgtttattacagatttattgggggaggcccaaggagaagacctatcatcatgtcacgggagctcacgttccataccaggaaaggagtgttcctgtcaccaggtgaagggggaagggtcctgggacccggcagtgggaggcctcggggaggggtntcatcagagtcttgaatggacccagacgctctcttcccgccaggacaggatgcgtaggagcagagaggaagcagctttgctggggaaccaccctggggtcgtttacttgaaccaaaggctcctgggggccagccagagggccaggggaggttaacacggtgcttcaggctttcttnttcttggggccc

SEQ ID NO: 2783 - DNA, 211 bp, Homo sapiens
  Genbank Accession No. R10138
  unsure (1)..(211): n = a or c or g or t
tcaatatttattgaaatactgaaaaaaaantccattttnttgagaagttcctggcaagaactgacatgacaatatgtatttcattgatacagtaagaaaacatcaacaagtaactgacttcgcactctaaacattgcatggattcaagtccaaggcagctgcagatctgtgatacaantaatcagncattagngattgtctgtttacaaac

SEQ ID NO: 2784 - DNA, 437 bp, Homo sapiens
  Genbank Accession No. R10287
  unsure (1)..(437): n = a or c or g or t
cctcaaatatcaagaggccctgaggtagggtggctccaggaatgcttaagtgagtgcttctttgacatcactaagcacttggcttccatccatcttccaacctcaccaaaaagggttgtcctcatgactacaagccggctgacatggtgccaggaatctcgtcatgaacatatggtgttctcagcgcaacaagaagacatctcttcttgaactgaagagtgagggtgaagaaaactttccctgaaggcacctccaccaaaagatttttcttcaagattcactgggacaaaaatacatcacatattcatgcataaacccaatcacttgcaaagggggaatcaaattacccattaccctaaccattaaacttaattaggggttttatttctctngaggctagggggagatcccttttcccttgaaggattgggagtttt

SEQ ID NO: 2785 - DNA, 223 bp, Homo sapiens
  Genbank Accession No. R10378
  unsure (1)..(223): n = a or c or g or t
tttttttttaacacangtctacatttatttggtgaatattgcatatctgctgtactgaaagcacattaaagaacaaaaggcaaagtgagaagaatgaaagactactcacaacagttatcatgattgagcatggatatgttcagaatgagtatttttcaaatcactttaaacaaagctgaattgcagaaacgaaagcccaacagcagcaattaaattacatttg

SEQ ID NO: 2786 - DNA, 267 bp, Homo sapiens
  Genbank Accession No. R10662
  unsure (1)..(267): n = a or c or g or t
agacacatctatttatttataatccactgtgtataaaggaatactatcagaaggcaagtataagtcttaagtgctaccaacacttatgttggnacactttgtatatcacactttgatacaacactttgtatcggnatacagagaaagaagaacacatcccacagtgcataaataaccatatttaacacctctcaaagactttgtataggatcaggcaggttagccaagctgcagggntatttcccatcttctgtggaaatgtttggg

SEQ ID NO: 2787 - DNA, 319 bp, Homo sapiens
  Genbank Accession No. R10684
  unsure (1)..(319): n = a or c or g or t
ataaacttttttgtgtctatgtcatatttcataatgtttttcctaaatgcttaacctaggaaacacatgtgtgcacacccatgccaaacacacaaatgaatttaacagtgtggtttatgaaatgaaagcaataatagtttgactcttcagaacctcttcattgtggcctatgtcaagctctataatcttttctcctcaatgggagggccatgggttaaggggacagatggataaaggtacaagggtttttcaattgcttaacntgccccaaattttccanggggttatagggnatttcntccaaaagggtggtttttgg

SEQ ID NO: 2788 - DNA, 262 bp, Homo sapiens
  Genbank Accession No. R12472
ttattgaaaattttattaaaatccttcatttatcttccagatagtagattctattaaccaagttgcataaagagttctgattcccagaggtaagaactgagcctggctttctagttacatgtttactggtaaccccgtctttccctataacacttaagcatatttaaagaatataccctcccctgcctccagccagggattgtaagctcctcaagagcatggctgtgtcttttaacatcaagggctccagggtgaggaagag

SEQ ID NO: 2789 - DNA, 357 bp, Homo sapiens
  Genbank Accession No. R12579
  unsure (1)..(357): n = a or c or g or t
tttttgaggattttgtgtggctaatgtgttctagaagcagagactccagggagaaccagaatttatgaagcctcgtgcaacatggngctttctcaccgaggtcatatgcctggctgctgctgttccactcagctccatgagccacgtttgttattttatgtttcttctgtgcttttgctcatttccaccccatgtgtttatagaccttttttcagccctttttctttgttcctttccctcatctttttgcctcaggtaggaatccatcagttttcctccccctccaaatgactgtgtacccccagctgctcagggactttgggaggtgggggggcggggctgggggggatctacccc

SEQ ID NO: 2790 - DNA, 469 bp, Homo sapiens
  Genbank Accession No. R15740
  unsure (1)..(469): n = a or c or g or t
ttttttttttttttttttttttttattgcactcttttatttacagaaaacacagataaagcatttcaatttcaatgttcatttagcaaactganccactctttttttttctttttggcacaaagaaatatcacagatggaccccgagatcaatcagaagctcataagattcatcagtcatcactggtccaggggcggccacgagactcagacagacagacagcatcaccacagactggaaacagaaacaggtccacgttcacctcacagtaaaaacctgcctcaccgacagcaaagggcgggcaggagggggcagtttcgctgctctaaggggggaaatgggcgtcaggggcaggaggcagggntggggaaaggntggacaccnttcataatttagagacaagtggtcctcttgtttgtatcctcttaccttgattagtaagacagtgcaaaaactagntacccgtcca

SEQ ID NO: 2791 - DNA, 224 bp, Homo sapiens
  Genbank Accession No. R15825
  unsure (1)..(224): n = a or c or g or t
ttttttttttttttttttaagagtcagtatttattctgattaatattttacaaaattttgacatttaatttatgtaaggagggctaatttattaaacactttacaggtttttctttccacagaataacacggtaagtagcaaaataatacttggcacagttataaataaagaaaatataaaataaaaacatccntagcttaagtacaatgatgctgttttacgc

SEQ ID NO: 2792 - DNA, 401 bp, Homo sapiens
  Genbank Accession No. R16098
  unsure (1)..(401): n = a or c or g or t
ttttccatcatctcatcatttaataaatatttattgaggacctactaagtgccagcactctgctaggcatggggatcagatggcgaataaaaaaatacagtgcctgcttgtaaagatatcccaggccagtcggggagggtggtccctcctggaggngaagcaaagtccagactcagagagggcatgcatgcacctgggtgaagaggaggagggtggaggcagaggccaggcacacctcacccccggagctgagagcagaaatntcttcattcttcaaggantctctgaggacgtgctgcacagctgggaaatgccaacaagcagatccngctttgnaccctccaagctttcatctttcttgtccctcaaactcttcatgtnttgggacattgggcacccaa

SEQ ID NO: 2793 - DNA, 417 bp, Homo sapiens
  Genbank Accession No. R16144
  unsure (1)..(417): n = a or c or g or t
tttttttttaagttttccaataatttaatcaatgcaaatatacacatanacacattctctacatcaatagtattcaacagtttttatcaaaaggagaaaattttgattttataaaggcagtgganataaaaaacagtaattattaagttttgctcaaggaccatctagaaggaaaatttagtgacacatctgaaataagcaactgatggccagcctagccttattaagtaacacatattcaaattgtagatctccccctcctatcttccaccccatagctaagaaaggaaacccagggatagaactaattgaactctattagccaggggaatcgaacccagtgccaatagagagatggnctcccaattagtcttcaaatgggacaaagtcataacactggttttctttcgatgttgg

SEQ ID NO: 2794 - DNA, 382 bp, Homo sapiens
  Genbank Accession No. R17762
  unsure (1)..(382): n = a or c or g or t
ttttttttttttttttttggcacacagaaccangtttatttctcatgaatttataggaccacatgtcagcacagagcaaatggtacaagtgcagatggctggggtgagggcgggggctctgctgctgccttctcttctctccagctgcctgagtactggcacacagcgggcagtgaatctgaggagctgtggcctcacagtcgctgcaggctgagcagaaaggagggccaggggaggtaagantcactcctgcaggagcgggttggtgatgaagggctgggggaactcgggtctctctgggatgaagtcacccctccttcctgggccggtccccagcccntccccacctgggccagctagctggggttccctgcagcagcgg

SEQ ID NO: 2795 - DNA, 388 bp, Homo sapiens
  Genbank Accession No. R19808
  unsure (1)..(388): n = a or c or g or t
tgtttgctcttgacagggtaggcctcttaaaagaaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttagggtaatgtaagctataaccctttgattttcaaggaactaccgaataagtntatgaagaggtggtttttttaaaactttcangttgggaattttt

SEQ ID NO: 2796 - DNA, 403 bp, Homo sapiens
  Genbank Accession No. R20817
  unsure (1)..(403): n = a or c or g or t
tttttttattagttattttgcttttaataaagtaaatgtaatgacaggagtagggaggngacaaacacatcaatatatatttttcttatggnnagnttntttaaantgtacccggggtcaacaatcacgccagctttgttctactattgcagaaacacgcttttcatattcccgtttgttctcctgggacagctgagcagcctggctgtttgctggactattgggattgggttcanccaacagagactgtatggatgttagaatggaagacacatcataggttggactccaacggttctgaagtatgtcccagaccatatactacccatctgcataggaccatttgggatggggaccatcttaggagaccaatctaacctgtagggngggttttattttggga

SEQ ID NO: 2797 - DNA, 365 bp, Homo sapiens
  Genbank Accession No. R21232
  unsure (1)..(365): n = a or c or g or t
aacatgaagtgagctcacttttaatggcacagaaaaccaataacgtattttgagcagctttgatgaaaaacatcaaagaaataaacctcagacacccaaatgatctaaacacaaagacaagaggtttcagaatagtgtataagaaatccagtaagatgaacaactaggacctactggaaattaaaacagttttaaaaaaaaatccggccagggtgtgggtgaagagagcaggacacctttgtctttgttccttaatctttaggaggcaacacattcagttttttcaatatggtgttaggctgtagggtttttccatatatgccctttatcngggggtaggagttttccttcttatttccccgttt

SEQ ID NO: 2798 - DNA, 485 bp, Homo sapiens
  Genbank Accession No. R22196
  unsure (1)..(485): n = a or c or g or t
tagaatcacaancccaaaatatttattttgttctttttcatatgacactgttaaaacattcctactacagcaatactgctctccaggagcttacaatctaaaacagtcaacattaattgtagacccagtaattaaggcattatatcaaatgcagactttgtatcttttttttttttttgagacggagttttgctcttgtcgcccaggctggagtgcaatggcgccatcttggctcactgcaacctccgcctcctgggttcaagcgattctcctgcctcagcctcccgagtagctgggattacaggcatgcaccaccatgcccagctaatttttgtatttttagtagagatggggtttcaccacattggccaggntggtctcaaactcctgacctcaggtgatctgcacccccgnttgggctcccaaagtgtgtgagccactgtgcccagcccagcctcgttccgaattnttggggctngagggca

SEQ ID NO: 2799 - DNA, 267 bp, Homo sapiens
  Genbank Accession No. R22565
  unsure (1)..(267): n = a or c or g or t
ttcanctccttttattgacagaaatagaaatttgtgctgcagaggcagtagtacctcagagcatgagaaggtagtcaatggggctgacatgacaagccacaatgctggccaggggtcctaccatagtgggagaaccaaaaccacaaaaatagcaggaggtagcaaacatccccaacacccagtgtaagcatttccatttgcagagagcttggccatgcatctttaaaaacggggtccccttcacagctgggcagggtatcatgtcag

SEQ ID NO: 2800 - DNA, 298 bp, Homo sapiens
  Genbank Accession No. R22905
  unsure (1)..(298): n = a or c or g or t
atttggaactttgaatattttagtatatttttctttatatttaacagcatgggactattaatagggcccataccagagcagacacaatttacaactgcaagttttacccatgaattatgtgacaaaatctttttgaatataaaataaccagcatttctataaaacactgctttttaattatgcaattaaagngatatagcaaaataaggacgtttttatttctaaagnaaatattttaggncaaagttgcatcagggnaatccaagggatttctttggccattttcaggagggggttt

SEQ ID NO: 2801 - DNA, 218 bp, Homo sapiens
  Genbank Accession No. R24507
taacaagtaaaaacctgcaaactctttattaaattctcccatttcatctgtacagaaaaaaatgcacattatgttcagaacatatctcagtaacatctcaaaattacacagcatgaacatgtaaaaacaagggaccaccacgattttatacatagaaaggaaacccatttacaaaagaggcttgttaattgtatttttttctttctttcaaaaacaaa

SEQ ID NO: 2802 - DNA, 468 bp, Homo sapiens
  Genbank Accession No. R26706
  unsure (1)..(468): n = a or c or g or t
tataaaaaatttattgagatgatgtaattataggcttttctttaaaaattatttgcaactcactggccctgagaaaaggcattttttttgtttttttttttcttttttgttacattcatttgattcagtcccttataaaccccacacctcataaacaagagattagaaactaaacaaaaaggggggcggggaaggaaattctagagtcgttctgggtttgcaggtgggttgcgggtcacaaagaggaaatcatcaaggaatgttcacttgggcatgtgtggaaaggattcagggggggnctgcagctgtttaggtgtttgatgcagttgggggccaaaagngtatcagggttagnccttctgtgggggttttaggggaggggattatggggggccctcccntccccacccccactgggcctncccttnttgtccncagcccttttatttcctactcccgagngggggt

SEQ ID NO: 2803 - DNA, 346 bp, Homo sapiens
  Genbank Accession No. R26744
  unsure (1)..(346): n = a or c or g or t
acatttttctaaagaaatatttaattggtagtcttctagaaagaaggcttttcatatagtacaaaaacatgcagtcggaagcactgagaaaactgggcaacataagagaagcatgagatgtgacatgaagcagctgatagtctatgtaagtcaaaaataaaattctaagcacacaaccaactgaatcgacccttccacttggccaagagcattctaaagtaaacctgaaacactagctcaggccatgatggggaatggggtgggtcagacataccntcattataccnttccctctctttggggaattcagggcacagtgggacccagcatttaaccatttaaaaca

SEQ ID NO: 2804 - DNA, 177 bp, Homo sapiens
  Genbank Accession No. R26904
  unsure (1)..(177): n = a or c or g or t
aanatttgaaaacttttattttctcaaatgagcaccaacacagattggaaatatgacagaaacaatgcacttttctctaatactgaatcactatgtacaaatacaggaaaaggtgaagacaaattatttgaaaacaattacctttgttataggaagcaaagtgacctggaaaaatgc

SEQ ID NO: 2805 - DNA, 354 bp, Homo sapiens
  Genbank Accession No. R27016
  unsure (1)..(354): n = a or c or g or t
gngaacgtcaccggtttaccttcacgtggccattctcctgtccgttcgctttggaaggcncgaggcacagcgnctccccaggcctctccgcggcggcttctcccttcgctgcggtcttggagaactgggcacccatgctggcttcttcaacaaagaaactcaacagatccaagaggggaaaagaagagcctcgggttggtgtaacgacggggcgagcagcaagcagcggcggcggcaacaagcggcagggccacacacaccggagggagggggggttgggggttggtngaaaaggncaagaacagaacccattttaattacacttcccgattaaaaaattttttagttccgagg

SEQ ID NO: 2806 - DNA, 224 bp, Homo sapiens
  Genbank Accession No. R27296
  unsure (1)..(224): n = a or c or g or t
tcagaaagaaagaagtcaaattttatttgtttgtagatgacatgaccttctgtaaagaaaatcacaaagagtcagccaaaatgcaactggaactaacaaacacattcagtttatttgcagantagantaacagcaccaaaanttagttgaatttccatacattaacaataaatanttttaaangaaanttaaaaaccanttccatttgctaaagaacttaaagt

SEQ ID NO: 2807 - DNA, 253 bp, Homo sapiens
  Genbank Accession No. R27432
  unsure (1)..(253): n = a or c or g or t
aaagaataaaaacatttattttaaaaataccatttagcatcaattgccccaagtttggcaggcatgaagagtgggcagttcatgttttattagtatataaaattggctttacaggaagcattatggcaaaaaaatgaatacttattatgaaaactgaaaaagagaagtgagtagtaagctactatcagancgttaaggctaagaaaatgtcactntgcaatgaaaaccatctcctcctctaatanggtactaa

SEQ ID NO: 2808 - DNA, 463 bp, Homo sapiens
  Genbank Accession No. R28636
  unsure (1)..(463): n = a or c or g or t
gcgagacaaagtcctttattagaaaatatatcaaaatcccagccccctgagccaggaccagaagagggagctattccagcataggcagaaaatgcccagggaggggnttccttcaccaaacaanttcccgggaaccataantagattaantnttcacagaggtccgaggagaagccagntcantcttctctccatggaagagggaggggnttggggtccagccctgntcctactntaggggcagggantcctagggantcgtcacataaantcatgacatcaaggtttcacagtcataagccctacagggagaccctaggagagaggggacccctgagggtnttacagggagcccagtttccagttccaggcagttnagggggagngggccccttaccccctaggcacgggcaccagagttttcagttttcccttnacatcccttttgnggaacgttnagggg

SEQ ID NO: 2809 - DNA, 311 bp, Homo sapiens
  Genbank Accession No. R30931
  unsure (1)..(311): n = a or c or g or t
tttttaggacanangggactctgttttaataagcagcttatagattttagcaaaccatattnccnatgacantgggttctcananaggtctgcagttcaaaatccaagtttgaaatctgggacggaaggcattctggaaaacggagaatctaataaaatcaatgacgtctcatgttcgatgctggctgtcacggaagggctgggccatctgttgggtctgaggtgtaggctgggtctcgtgaatcccactcgggtacanaatcggctaaacactaaaacatgttcaaggcaaaggtacatgggggcnccag

SEQ ID NO: 2810 - DNA, 301 bp, Homo sapiens
  Genbank Accession No. R31104
  unsure (1)..(301): n = a or c or g or t
ttttaaatatacaattttctttattaaaaataatttacagcatcagtaacatatacacaattgtcatcaactgaactttgcctccaatatatttctatacaatacttaacattattgancttaaaactgttacactgttttgttggctttaaataatagacaatgattttngtctattacttaggngataggncaaaggtgattactttggttacttaggngaggatatatgggnttcatggcccccatattatggggtaaaattgatgggaacggtcnggcaatatcnctctttnggggg

SEQ ID NO: 2811 - DNA, 468 bp, Homo sapiens
  Genbank Accession No. R31107
  unsure (1)..(468): n = a or c or g or t
catctctccttttttctttggactttcctgagaccccctctccttggccagccggtgtctgcatcttgcagctctttcagctgtaatccactgttattataaggagccctgttgctgtggtggtaaggagtggggaagggaagcattccattttcttaggattacatctcaatcttttggntgggcctatgttgctgtactgtgacctttacaaatgtttcttaacctttttcctccttccttaggttgacacagggaatctaggagggtgactcgagtcagaggaactatcttctccccaggatgggggataaggactctggggtaaaggcccttttccntggggagaggtaaggtctttaatcataggggggaacatttctgagggcgcactttcaaagggcatttacntttccccttnccctttnccagagccnggggggaaggggtntatcttnggggtctttt

SEQ ID NO: 2812 - DNA, 241 bp, Homo sapiens
  Genbank Accession No. R31607
  unsure (1)..(241): n = a or c or g or t
aatgtttaatctttccaattaaatacttccattccataaacttcagaaccaaagttagataccaacaagagactgaagataaatacagtgtcaatagtatcaagggactagcccatataatatacttgaaaatcgtattaatcaccaataaagtaccccaccataaacaaaatacacantaaaangtcaaggatacaattaaagacaggccaacatatgaggtggaccattgacaggagng

SEQ ID NO: 2813 - DNA, 484 bp, Homo sapiens
  Genbank Accession No. R31641
  unsure (1)..(484): n = a or c or g or t
cgttgtttgggctcttataattaggtcctgagattttataaaaatttagtctgtagctttttaggttcttcactagagttggttgtacataataataaagaatataaagtatcccaaaattcttttaaagtctggatttttccgctaatatgtactttagagaatattttgttcatgcatacttccacgttaaattgaaaatgtcttcagcttctcttgggtaaatgtgaaccatttgttttttattgtgcttggggggagaggggtattttaatataatttttgccctaaatcaaggagtccccctctggaatgttaaattttaaatgtccaaaatatggnggacggatatatcttngaagtgaggattgccanatgcnttaaacnttagtnggggtttttnccaaaacggnggaaattcngggggnttttgtccnttggaggcnccccntaggggggaattgtagggggcntcggtttttgg

SEQ ID NO: 2814 - DNA, 340 bp, Homo sapiens
  Genbank Accession No. R31917
  unsure (1)..(340): n = a or c or g or t
gacaatgctaatgagtattttattgggccaggagcatgacatctttactgcttatcaatatagtnctttatcaaaaganctttaataaaagcaaagtgcagaacagtatatacagtaagtncctatttgtgtaaaataagaaagctacatttatttctacctacacagaaaattacaatacaaggacatctaaggacattccaagtaggtctgtggtaatgatgggaaaaatgaggacagggctaggggaaaaaaacttacttttgctaatctactctttggggtactgtttggaataggtattttcnataatgtttgtggaattactttnccagggtaa

SEQ ID NO: 2815 - DNA, 462 bp, Homo sapiens
  Genbank Accession No. R32036
  unsure (1)..(462): n = a or c or g or t
tcagtttacggttgttggtgcatttcctttcacatacagtgacacagagggagttcataaagttagaaaacaaggatgaccaaagaagcagctgagtgttctagacaaaccaacgataggagggagtgggggaggacgaacaatttaagcagcagagaagctcccagcaaacaggaacagtctacaaagntcagacaggcaaacaacatcctgaaggaagaggaagcacattttntgggcacaggccatttcccattgtctttgatgggatctcttgggaaccacacttccattctgctttacactttgctaggaggaaagttcagggtgatccaaagtctcaggaaacactccttacttngggtttttttcccnacttagggtctttacggggtgttgccctttttnaaggncctggcaaatttcaggggnccagacagttcgtncttgcaggcattaaat

SEQ ID NO: 2816 - DNA, 464 bp, Homo sapiens
  Genbank Accession No. R32440
  unsure (1)..(464): n = a or c or g or t
ggtaggancagaatactttaataagataccagtgtcaaaatacattnccttataaagttaagcncccatacagttataatgttgtcagtaggaattcgacaatataataacgctcatgaaatcgttacgttgacaggtagggttaatatgaagcttggaatattttccagtgttttaggtaaaactgccaagggntaaaatgcccttaatgccggggcaacacacacagggaaatcaaataccaggcatttacacgtcgtaaacccttcaagttctggccacccgtgtggggggtaatggccgtgcggcttaaaatatggattttacggnaacaccatggactaggggaatttccttcatagggaactttaaattttctttttgganggctattttctctgtttttgggggcattaggtcttttccggggtttnactaanaggttgggggcccntgtggttttt

SEQ ID NO: 2817 - DNA, 363 bp, Homo sapiens
  Genbank Accession No. R32490
  unsure (1)..(363): n = a or c or g or t
aacatttaagttntgcttttattaaatacaaaagcaaaataagctctaaggagtaaggtagggctacttaagggcgttttctgtggacagcggacacagcaccattaaggttagcttagatttgaacaaaccatgagcagacagctaactacatgttatgtttctcttagtagttttaggggtctgcccagtaatcaagaaattttacttctccagaatacatgaacatgggggacccnaaggaaatgtaaatatttcggaaaaagcacctacaccaattaaaatgaggacggcaatccttatgcaggggccaggatgttctnccccatcttaccaattgtggccattttaccnaatttnatt

SEQ ID NO: 2818 - DNA, 195 bp, Homo sapiens
  Genbank Accession No. R33146
  unsure (1)..(195): n = a or c or g or t
atatcaagtgtnttttattttcacaaatattttaaaatgcagctacctttgagccacaaaaggaaaaagcagtattccttttatgtatttgatacaaatattaaacataactcagttttagttcattagctcagctcagtgaaaatagctcaggaaaaaaaagtcataggtaatgctattggtatatgcaggaaa

SEQ ID NO: 2819 - DNA, 348 bp, Homo sapiens
  Genbank Accession No. R33498
  unsure (1)..(348): n = a or c or g or t
nctttttaataatttcagaataaagtctcatttcagtgcagtgggctgggtggtgggggagagggttgaaagccccacttgggtccccgagggtccattgagccctctcaggccagctccaggaatcctgggcctgggtcacagagcagagttgcttgcagggtcctagtggccatcgggctggggcaggacatcatctctcagagggtcagaggctcagagctgggtgcagctcagcaggtcacggccctccaccagctctgggttctcccgcatcatgtgggtgggctgctttttcccccaccaggggcctnagctccagcagctnggtggggtnagcttagcaac

SEQ ID NO: 2820 - DNA, 410 bp, Homo sapiens
  Genbank Accession No. R34133
  unsure (1)..(410): n = a or c or g or t
taatagggaatatttatcacagctatacatttattcatcatttaattcccatttatttattcattaatttattcaaacacttcttaagcatgcaccatgtgtcatgcccatcttagaggccacaaaggttctaaaactattacttgtggacagaaaaagagacccatatacatgtaggcattatgtcttattgggaattcagagcaggaagagaacacatctgggctgggggcaggatgagggaaggacctgataaattttctattgaacaattactctaaataagtgtgctttctttaggatgggtagggntttggaccccggggnttcaagattacnggggattttgagtccaaagttttgggcccccttgggggggaaatcctgccatttttgccggggtcctgggg

SEQ ID NO: 2821 - DNA, 348 bp, Homo sapiens
  Genbank Accession No. R34362
  unsure (1)..(348): n = a or c or g or t
agaaagaaanaactttggctttattatttttatatttatggtatatccaagctgaaaaaagtattcatcatatattagtcaacaagaaggaaaatgtataggaaaaatctcattcactttttaggagagagccaacaactgtctaacactttcactttgtgggttaaaaccacaccctcattgctttataaatctaaggcttggctaaaaaacaaacaaatgttggggccacacaattgctccctactttactccctccctttgtgggatggatatggcaggcttttttacctggcctccactttcccctaaatggatcccctgggccatcctaaaaattatatattt

SEQ ID NO: 2822 - DNA, 329 bp, Homo sapiens
  Genbank Accession No. R36109
  unsure (1)..(329): n = a or c or g or t
gttactacaaancatattttattacaaagcactaaatacaatgcggataatcccagactcaagacgtaattattccaacacatatcctccagcagaagcagtttccgaggggaaaaccgaagcctatgccttccttcttccagggntacgaagcggcccttgcccctgtaggcttcgtccttagggttcccgtcatgaaggntaatcaggaagggtttctttttcagcccaaagacggntgacgantaaagccatttcaggtgacagctgggaaggggcactgcaggaaggacaaaaatgtaccnatacggtaggggcacttccccaac

SEQ ID NO: 2823 - DNA, 320 bp, Homo sapiens
  Genbank Accession No. R36228
  unsure (1)..(320): n = a or c or g or t
aaggtagccttttattctgattaattaagatacatctttaagggttattctggtggtaagaacatttatcttgacttatgtttaatttttttaatgctttggcagatgaagtaacatttgaaaactgtttgtgaaaatagtatgagactggaaagattacgtcgtgggtaaaagtttcacagttttccagggtatttccttatactgaagaggccttgaggcaaattcaacattctgggaagcccagactgacaaaggcaaaacaggattttgatgttgcctttgttggggccnggggaatgatgctgctgcttggccag

SEQ ID NO: 2824 - DNA, 329 bp, Homo sapiens
  Genbank Accession No. R36947
  unsure (1)..(329): n = a or c or g or t
tttttttttgactgtgcatgatgtttattagtgatgacagtgaggtgaggcagggncttntggagatgctctgtaggtcacacactagagccataaggaagagtagccggggagacaggtcctctgtgccctgtctctccccatctaaccctaacctaacaagcggcactantgagtcagggaacaaagtctggagcccggttctccaaagatgtatgagggacaagaacagaantgacaggntgcagggcaaaagantgagaaaggcaaggaggcccccctaagttctcttgctacacatgccctnctttccccaaacccccattcag

SEQ ID NO: 2825 - DNA, 321 bp, Homo sapiens
  Genbank Accession No. R36989
  unsure (1)..(321): n = a or c or g or t
tttttttttttttttaannttttataagtgtttattaaatcaaggaccggttagatagatgatgggctaaggaaggtgggggaatncagagctcactgccctgtgggtctctgtggggccancccctgaatgcccatgtggccactgatgcccagcttcccccaacancccaacacaggcccaggncaatattacaaaagtgaacaaatgcaacctttttctgcttttacaaatgacatgtctccatccccggccagcaggggtaggggaggccggttgaaagtgacactccgttaaaaaggcaacaanttttntaaaatg

SEQ ID NO: 2826 - DNA, 396 bp, Homo sapiens
  Genbank Accession No. R37128
  unsure (1)..(396): n = a or c or g or t
ttttttttttnctgccaaaagcctttaatatgccctggncccaggctgtnttcatgaaaagcggacacagcagtgcttccaacttcaatggttcccaggttcaaggttcctcccagcggaggtgggagggcaagccctcacacctggcacccctgaagtgcatactcctggaggaagtcgttgagctgggacaggctgcccgntggcgtngctccggacaaggctttcagagggcatntcctcgatccagctattcgagtccagcaggtactgggggtttccctcgaggtcataggtggccccatntagacccatgatcaaatattctttcccaggttccaagcgaaggggccaggaggttcgaaccaggnanttncgcatctgattagcagcggc

SEQ ID NO: 2827 - DNA, 296 bp, Homo sapiens
  Genbank Accession No. R38076
  unsure (1)..(296): n = a or c or g or t
ttttttttttttccgaagattgtttggaatttattctcttaaataagaatgtaacatttgttaaaaaaaaaattaaaagcacgacaacttggtttcacagtcaacggcaaaaacaaagttacacanttaaataaaaactcacaaagaaacacaccaagaactcacaagagcacaagttaaaaacaaaggcaaaantggaagtggagagaaggcgggcagtagacaggcagcagtggcgtgttccttggcacagctaatcctctcctgttggggctctcgtaccgccgccgggaagc

SEQ ID NO: 2828 - DNA, 257 bp, Homo sapiens
  Genbank Accession No. R38185
  unsure (1)..(257): n = a or c or g or t
tttttttttttttttctggttttcctttttatttaatcaaaggacctggngaataaacataaatacannacaattacttcaggatcattcttcatattgtatacacacaaacccatgaacataatctgaaagaaacctgtaagacaagcaatgaaatgcatacagctttttcttccctcgctcaaaaaaaagtttaaacacacaaacttacaatctcatcagcacacactctcttgtgacaaatgattcaggcataa

SEQ ID NO: 2829 - DNA, 429 bp, Homo sapiens
  Genbank Accession No. R38239
  unsure (1)..(429): n = a or c or g or t
aganaattnnttttattcagcctgatatagatcatttatgaaaaactaacagcaaacatcatcctcaatggtaaaaggctgaaggatttttctctaaggttaggaacaaggcaaatgcctgctcttgccactctattcagcatagtgctgggagttctagacagagcagttaggcaaggaaaaggaaatctaagggcatccaaattgggaaagggagggaaggtaaaattatctctgtttggccaatggatatggattttatatggtatggaataggaaaacccttaaaggattccncccaggggccnggggncggggtgggcctcacggcctttttaattccccagcactttggggggaggggcccagggtgggggnggggtttgctttgagggnccaggggggtttccaggacttggccgggggggg

SEQ ID NO: 2830 - DNA, 476 bp, Homo sapiens
  Genbank Accession No. R38280
  unsure (1)..(476): n = a or c or g or t
tttttttttttttttttttttaagtgtggaaatgtttattaactngtggnggaaactgaactgaanccaacctgatcacctcctcagagactcagcattgtgaattgcccctacaggtcatttttatacagcatgaagtagccctgcacctgggaagactgatctggtttgtagctcgaaggacatgttctgcaaagttctcagctaaggaaggtcctgccctggatagaacctctggaacatctgggtcagctgccagtgtgagcagtagcccacgtactccttcaggtccactcgccccgggntatcagggcagggtcagcctgtcaacgtggttggtggtcatgaacacgatgcggggcntcggtnggaagccacaccatccnaggcatttagcagtccacttnagggttaggcnacctagggctttggnactttanttggggtnttcacagccnagtttcganttaggnaag

SEQ ID NO: 2831 - DNA, 304 bp, Homo sapiens
  Genbank Accession No. R38511
  unsure (1)..(304): n = a or c or g or t
ttttttttttttttttcttagtattaaattttattttaaaatgttaaaaacatgattaggnaaaaattcccactctacccatccccccaatatctatagaacaggattcagagcagtatttgtcaatgtttgcctaggatgatcaggatgtttgaaccactgggagttttctttaaactgtgtatttctgggtctactccagatctacctaatcagaatctctgagggtggngtctacaactgatttttaaaaaacgntcccggggattgtttttatactaaaatttgagagctactgggttta

SEQ ID NO: 2832 - DNA, 401 bp, Homo sapiens
  Genbank Accession No. R38709
  unsure (1)..(401): n = a or c or g or t
tttttttttttttttttgatttctcaacatcaaagtttaattattacaaaatagttcaagcaacatgatatgantttcaaaaactgtatgttgcttngcttcctngttttgctccaacactaatcatgctgaggtttttgaagcacagctatgactagggcaggcactcttgatttcagtcacaaaaacccttcttggatgaacaatacttgttcttttcagaagaaaagcaattttaccttttctatttctattatgaaaaacagagctaaacaatttttgtatttttagtagagacagggncccaccacgctggccacgntgggtctcganctcctttcaagntgttctgcctgccccggcctnccaaagtgccggggnctacaggatntgaggncacc

SEQ ID NO: 2833 - DNA, 399 bp, Homo sapiens
  Genbank Accession No. R39191
  unsure (1)..(399): n = a or c or g or t
ttttttttttttttttcaatcaagnttttaatgaaaagatcataaaataacagtttcttatccgctgtacatttaagactgcacacttctgaatggagagatcagtcgttggtgaattgcttttctatgacactgggcagctntntagctcaagctctgacctgantttatacaaactctcaagggacatgaactcaatntgacaagtgacagcggcggtggccagtacaggagtgcgatcccggtntccctccccccttntgggaagggcataaaacaaaacatgatccctnttccagttccaattaaacaaaacagctntaaccccntccctnccccntcccnttcgagggnttttgcgaggaattgagccagtgcccaacctgggggtcccccccg

SEQ ID NO: 2834 - DNA, 347 bp, Homo sapiens
  Genbank Accession No. R39234
  unsure (1)..(347): n = a or c or g or t
ttttttttttcaaggggaagatgaccgnctttttattaaaggttaacaccaacggaaagaattgagaaggaatacacaaaaggangggggagggacacaaagtcaccacttnaggaggtggaagggcggcacatcagtaaaagaacctcaggacagccacatgctccatgccctggttgggggaagagggagagaaaagcgccattgatagcttggagctcgtagaagggtctnaagcccctgaacctaacaccagagccacaagccctgcccctgaggnttcacacantactacacaantagacacacntaacacacacaagacnttttgaaggcaacacccgaga

SEQ ID NO: 2835 - DNA, 331 bp, Homo sapiens
  Genbank Accession No. R39238
ttttttttttgtaaagacagatatatttatttcatatgacagcacgtttcacaggatatgtacagaatgtctgtgtaccactgactttaatactgtacttctataaagtttatagttataaatattgtatgccacataagcaataaaattcttacatataaacagcaatctaatatagagaacacagagttcacaaagagatccttagtgtctaacttctgctctgcttttaacagaactagtaaatatttaataatacatagggtaatggctagttatttgcagcatacctttaactttcataactttgtgcattttcagcaacttgccc

SEQ ID NO: 2836 - DNA, 396 bp, Homo sapiens
  Genbank Accession No. R39390
  unsure (1)..(396): n = a or c or g or t
ctgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtgggaattccactgggacccaatctgttttccatttccattgcaatactactaaagccatacaatatcaaggcaccctccctctagggtccgggggacttatcacaggaggaggcagggcatgttagggttttagggactgggtttcgggggggtcgagtgtagggggnaaac

SEQ ID NO: 2837 - DNA, 262 bp, Homo sapiens
  Genbank Accession No. R39610
  unsure (1)..(262): n = a or c or g or t
tttttttttttgcatggggtaaccctttatttttatttaacaagtacatttggaatgaagataaggcaacaatggcaaaatttctataatgttgctagcattttcccaaggtaaagccagggaacaaacttgtgtcctttctataagaacttctaagtgatgtcccctctaactccatggacagacactagtggtngtgaagttcataaagttttgaaggtggcaaacagcttattttgtccnttatcataattggnttaca

SEQ ID NO: 2838 - DNA, 450 bp, Homo sapiens
  Genbank Accession No. R40057
  unsure (1)..(450): n = a or c or g or t
ttttttttgttttccaagttcctttttattcaaatgaatcagaactgcaatctgcacatgaaaagacctggggggaatgcctacatctggaatttcattacatcaacgttaaattttgtccgaccagttcttcattgctgatcacttttgataatgacagatccaacatgaaactcctgaagcaaatgaatatttaccttgtgctttcatgcaaatttagggaccaaactcaaaggtttcatccatgctgggacaccagatctaaggaattgtgacagggatcttctcatatttcattttaggaacacttgatactaggtctggatggatactcatgttaggctggcactccaattaatgtttatcctantggcaacaggaaaactctggttaaactggtacaccgtaattgggcatctggtttaaaaacaactccncttttggaacgga

SEQ ID NO: 2839 - DNA, 235 bp, Homo sapiens
  Genbank Accession No. R40254
ttttttttcaagaatcataaagtttactgtttcttttccatcatttggcacatatccaaggcacattagaaaattagaaatcataaattactttgtagaaaaataatccctcccttccttctgtacatacacaagtatttccaagaacatggacaaaaccatttccctatcacaaggtcatttgaaaacggactcaggacaaacccatatacgtgtagctctaggccaataacat

SEQ ID NO: 2840 - DNA, 330 bp, Homo sapiens
  Genbank Accession No. R40395
  unsure (1)..(330): n = a or c or g or t
ttttttttttacggtagcaaaggaaganctttattcaggaggcgggggctctgggctggcantngggnatgcagggagaccctggncagtaggcacccagcaggatggcattgatgtgctccagggtcaggttgctgaagaccatgttgagatgctgtatcccgtgcagggcagcaggtgcacaggctgtggctggcggccctgccacangccacagagctcggtgctgcgggtcgccaccgtgtcatcaccatcctcatagagcacacccacagggtccgtgtaggggaagccgtggtcgtagatgtaggtncggggcgtgggcaggcc

SEQ ID NO: 2841 - DNA, 231 bp, Homo sapiens
  Genbank Accession No. R40492
  unsure (1)..(231): n = a or c or g or t
ttttttttttattcctgaaaaaaagatattaatagtttgataaggattgcattgaatctgctgattgctttagatagtttggacatctgtaacaatattaagcattccaatttggaaacacaggatgcctttctatttatctgtgtcttatttaatcagtatataagtnttcagtntataggnctttcaactccntgggtaagtttatcactaactgttttattatttccg

SEQ ID NO: 2842 - DNA, 291 bp, Homo sapiens
  Genbank Accession No. R40556
  unsure (1)..(291): n = a or c or g or t
ttttttttttttttttttttttcaccaaactaacatttatttagctttgttccctcccatccaagactgctgatctctaaacaagcatcaaaacccgaagctcattaacatcagagtgagcttcaataaggtgaacactacaatgatgtacaattacatcctaataattcaatgcccaagagccctgtaggaactnttgcaaggcccagggnttntcacagtatggcaaatggcactngggaaaatcattacctntttnggtcccctttattttggggggggtttaacatg

SEQ ID NO: 2843 - DNA, 309 bp, Homo sapiens
  Genbank Accession No. R40899
  unsure (1)..(309): n = a or c or g or t
tttttttttttacaaattaatatattttgaactttatttctccacagagcctgtataattataacagatatatttctacttacaaagtttaaacaatatgtaatacaacctttttaaatctgtgataataccatctaaaattttacaagnaataaggatgggctttctttgaaagttacaagggaagggnaatttgaaatactacatacattaggaatggggggaccatagcagggattcggcgtggcatatccattttattatcaggaattatctggtaggnatttgcnggtttacacttactgaggg

SEQ ID NO: 2844 - DNA, 333 bp, Homo sapiens
  Genbank Accession No. R40946
  unsure (1)..(333): n = a or c or g or t
tttttttttcaggttttaattttctatagactttattacacattattatgttacaagacaaatgcagataattcttaatttatcaaatttgtgagcttaattaacaaaaatatttgaccctcaccagaaaaacagataactctaaatctactctgnaaaatctaatcaattgcgaagtattacctatttgggggactatgtattatatcanaggtaaagnctactattctcacaggaacatatggggggtcattgggcagnccaaccaataatgganggtaaatattctaatatttgggggnaaatactgnggaaaactaataaattgtccgg

SEQ ID NO: 2845 - DNA, 464 bp, Homo sapiens
  Genbank Accession No. R42241
  unsure (1)..(464): n = a or c or g or t
ttttttttttttttgaaaacagaattatttattgcatacagcatgggactgtgatcaacctggncatcaaatgccgcgatggctgacagggcccaggcggcgggagtgctgggaagcccagtacacgtgctccctctctgtgggactccgggatccacggggcggatggttctntgagttgcgagttgttcctgtttgtcttccagcccccagtcctccccggccactctgattagccagcctagggtagggcctggcataaagtcacacaggcaaaccccagaagaaggaaaaagggcacctgcatgaacaaagagttgggttgcagaggntgcaccggggtaagacttccttcatgcagttnggagtccncccatgtngggacatcaggagatgncaccncacagaattggtngctaggttttnctgggttttggcccagagaggctnattcccattntttt

SEQ ID NO: 2846 - DNA, 266 bp, Homo sapiens
  Genbank Accession No. R43166
  unsure (1)..(266): n = a or c or g or t
tttttttttttttttttttttcttnaccaagactgtttttatttaaaatatacttggaataggtgaatattaatctaagcattttcctatcacttttaaaattttatactatgtactttgtattaaatagtacagtagtttcagtaagacatgtaaaatttgccattttaaccaccttaangtgtacaattcagngacatttattatatttacaatgttgtgcaaccatcaccactaattcatcaaattttaataatcttttaatt

SEQ ID NO: 2847 - DNA, 436 bp, Homo sapiens
  Genbank Accession No. R43174
tttttttttttttttagtgagaaggatttttatggtaaatgaggttttcaagtattccaagactgatttgatagtgtattctcaaaaaaaagccctacacatcatatcactcccagttaaacagtgctttgatgcttcatgatgtccacatttagggtcagcattcattgttcagctaagaacactgggtcctcggaatatggcaagcggttgaaataatggcctcagtttctatggcatgggtgcaaatcggtctgttagagctcacagtaaagagctttgtgaaacactgtgccaatcagcagtttccctttgtacacagaggcaactgtactgccttgcaacactgtgccattttctgcataaacctgtgtcactttaggttcttctgttaggaatgttctgggttcgaaggcacctctgattgcaggagggt

SEQ ID NO: 2848 - DNA, 330 bp, Homo sapiens
  Genbank Accession No. R43347
  unsure (1)..(330): n = a or c or g or t
tttttttttttttttttggctagaattgcatcgtaacagtgtggtcacactggntaagaaatgcagattggcaatcatgtacatctctgattaaaacaacactcacataaccaacacaatttgctaggccaaagtcttcacgggcaatccctggggtgggagtctgggatggggtggataatgaaggatacctggggttgcagaagtggggtgggaatccctggggcatcagtccacaggaggttggggccagcgatggcttcaggggtgatatttccaatatatatcagccctgggcacttttcgccctgctgctcacagcatggtcct

SEQ ID NO: 2849 - DNA, 235 bp, Homo sapiens
  Genbank Accession No. R43365
tttttttttgggttaatacttttaattacatgattgtaattatacaatttccactattcgatattttgtataaaaccagttacaacccacaagattttcaaatgtgacaatatgtatcaaactacatacatatgcaaagtttacacgccattaggaagctttatcttaaaaataccttcaggaaaataaacattcattcaaccagttctcttgggctttaaaaaatatgattagg

SEQ ID NO: 2850 - DNA, 427 bp, Homo sapiens
  Genbank Accession No. R43799
  unsure (1)..(427): n = a or c or g or t
tttttttttttttttttaagcacatgggaggagtgactttattcacaataggtaaaataaacataattaatttttaaaaggagaacaaatgaaattaagatagataattgcaataatcaataatattgttggtttaattcataaattaaagttcaagcctgatgccataactcataggtcttatatttattttncccttatcctgttaaaagatgtgtgagggcagcccgaggatataatttttgcctattcttttctcatccatgagggcatggaaatatcagnccctaccgaggtaatgtggggggcaaatctatttccagtttaaaacttacngtggatttagggacagacggatggtattatttcacaatatttgtggccacaatacacccggggggccattatccaatgggggccaaatccc

SEQ ID NO: 2851 - DNA, 482 bp, Homo sapiens
  Genbank Accession No. R43910
  unsure (1)..(482): n = a or c or g or t
ttttttttttttttggtgtctaatacttttacttcccagcagcataataccactttggtcaggttgaaccactgcacaattttgcagctctttcagaaaaataatgaaaacaattggaaagacatgatgtacatgcaaatggtgagaaaatgatactattgtccaatcctttcccgtaaatgtaaaatatccttagttcatctccaaactgtgtatttattataagcccttacatcagggattttgtttctttcagtttttgtagcaccaaatagacacagcggctaacaagaaataaatctgaaaagtcactgaaatatttatcacatgtcaggaaattttctggtctgtacctttaaccatgttcctgggcttcacatattcttcttaagngtaagctataacataaggttgagttcccacccgtgtttggctaccgntgtggtttgtttacctggataatactttgttaatatcctttg

SEQ ID NO: 2852 - DNA, 459 bp, Homo sapiens
  Genbank Accession No. R43952
  unsure (1)..(459): n = a or c or g or t
tttttttttgaggtttcaacttaacatttatttgcacactccaggtcactgctgagcccccaaaacccacagcctagtaacaccaacttcactttcaaggaccgcagagatagaccaactatataaatcttgtggaaacatagtaatttgggtgaggaaactatgacgctagaggctttgggatgaatattttgcataagcaaaagttcagaagcttgnaaaatatagtcagcctacaaatctcaaatttcacctggataaccgtaggcccttagccaccatgccttccagctctctcaactcccttgcctctagtttactcctcttcccatttcctacaactttgtagggggagcattttaggcaaagctatttcaaaagcgtggaaaagtccaactgatccaatnaaatttactcaggaaatttacactaacggggtngcttccaaattttgaaatt

SEQ ID NO: 2853 - DNA, 391 bp, Homo sapiens
  Genbank Accession No. R44025
  unsure (1)..(391): n = a or c or g or t
ttttttttttcctgagaggtaaaaatttattgatttctatcatatcagcatgttatgatatggtcacgcctgctcatacagctgacttcttagagccaaaagagaattttttttccttttaaaaatacatttgttcagcaggaaaaaacattttaaaaacaagcattttcatattaagtggaaattaaaaacaatggctttccccccgccaactcatgaggantagggctggtcagcaatagatctctgagtgcttccaatttgttttcaggcctctgtccccagtctgttccttgtcttccacagaaagtagttccagggggaaaaagaaattaggaatctcaccaaaacagcagcctaaatacagataggaaaattaagaggtagacac

SEQ ID NO: 2854 - DNA, 422 bp, Homo sapiens
  Genbank Accession No. R44479
  unsure (1)..(422): n = a or c or g or t
tttttttttttcaagaggctttttccgttttatttctttgggaaaggaaaacaaaaagtctttccatcacatatggtagagatatatatttatatatatttatatataattccttttgtggttggacgtcccaaagctgagtctgttcatatttttttctatttttttcttactaatgccttctcttctccctgcccctgtggcctaggcccagggttctaggggcaggtacagtgaggggtgaatgggaatggggcagtgggtcgccaggatgccctcccacccagctcagagacctgggtgagggaccacccaggaaggggctgtgcaggaggggttaggagggccacacagaggggggcactcatgttttttgtnggggggatgcacagcttcatttaaacagtcaccagtcntgggga

SEQ ID NO: 2855 - DNA, 425 bp, Homo sapiens
  Genbank Accession No. R44538
  unsure (1)..(425): n = a or c or g or t
tttttttttattacaatttttattgtgataaaaacacataaaatttaccctttcacatactttgtgtgtaccgaagagtattgttaactataggcatatttttatacaacaaatctcaaaaagcttttccatcttgcgtggctgacactcaatacccattgaacaactcattttctcctccaccagcttgtgggcaaataccgcagtactttgttcttctgagtttgacgttggataccccatataagtgggaaatggggtgtatttgtcctttcgggaactgggtttatttcacttaggcataacgtccatgttgtaggcatagggcaggaattttgtttttangggctaaatggatattggcattgtatggnatataatggcantttgttttacccnttcatnggtcangggggcatttactt

SEQ ID NO: 2856 - DNA, 475 bp, Homo sapiens
  Genbank Accession No. R44617
  unsure (1)..(475): n = a or c or g or t
tttttttttgagatggacaaatatctttatttacagcaacagatagaacagaccctccctcccttcccttcctttccccttccagtcttttccatactgttccncctcccgccccaccccaggctctcgcctagccctgccctctggggttcactgcgtgggttaggcccccaaaaaagcctaggaaaggagactggagagggctggctgagggtgggtggggcgtctctncacatttttctgtcctctaagcctggggtggaggagagaggcaggcaccaggagcagggagaggtagagagntacggccccaccggcccaccctncccaagtaactttcacagtnttccccagccctggntgccctttgcggcccctaccccagncctgnccctaggtttgtnctgttaggttntcagnaatttattgaacntggtaancaattaaagatttcaaggtttttttggccatgggg

SEQ ID NO: 2857 - DNA, 358 bp, Homo sapiens
  Genbank Accession No. R44761
ttttttttttttttttacaaaaggaaaaaatattttgtttgaaaatctttgctacatgtcattatttttgccactgtaaagcttagcacagatgccagcaatacagaaatggccaacaagaaaacaaaacagtcaaaaataaaaccctgaaggaaaagcaaaaacaaaacccccagagcatcttctcgctatcctccccttccccaaaagccctataataactgtacaatattatagtcttgatcacatttaaaaagtcgattattaaaaaacaagggttccattgggaaactcaactttttggtttcgtaaattgtggatataaatatatatgtatactgtaagtgtggcacatggg

SEQ ID NO: 2858 - DNA, 281 bp, Homo sapiens
  Genbank Accession No. R44793
ttttttttttcatcacagtatttaaacaattaggaattttactttatttcagaataagtttacagttgaaaaatgattatttactaaagccacattattcatacagacaaaacttttatagcaaaaccttggtacatgagcattaataatttgaatactatatggatatagaagatatttaaaaaatggaaacaatgtattccaaaggctgtaagaggcacaatatatatgcttgtactgggcctgcaaggcattatactataattcattaaatatgatcc

SEQ ID NO: 2859 - DNA, 331 bp, Homo sapiens
  Genbank Accession No. R44817
tttttttttgatggtggttgtctctaatatttatttgtctggttataaaattaatatgtgaggagcattggatttggtgagaacgttttgaaccctagctgtcacgtgccacctgcgggatctagaccagtgacttctcagaactgccatttcctcatctggtagacaggatggtaagccctgtcttgctcactccacgtatgggcagtgcagatgaaatgagatcacagaggggaagcaattggcaggctggaaagtgctgacaaatggaaggggttgtgtcaccaccctcagctgaggtagtaccaaggtccaagctcctgcccctccc

SEQ ID NO: 2860 - DNA, 325 bp, Homo sapiens
  Genbank Accession No. R44839
  unsure (1)..(325): n = a or c or g or t
ttttttttttgggtgtgaacacgcatttatttacacattgtcatcggtaggcacatacccagcccagcccgttgaagggacagatctcaggctgtcacccatggaacctgcagacccttccctcctccagaacccttgaaggcgaanctgaggagaaccaggnnttttaggcttctgttcaagagctaagaactaaattttatgccttcatctgatttctttccaaaaagtccatttcattaagtattcagacttcttagctccatcccattcatacttttngctctcctactacccacccaagattgttaataataacaataat

SEQ ID NO: 2861 - DNA, 235 bp, Homo sapiens
  Genbank Accession No. R44896
  unsure (1)..(235): n = a or c or g or t
tttttttttgcagtaacagctttaatctgtggtggcccctgccctacctgcatccaggcagaagagccgtttctcggggaattaaagcaggagcntttcccacactgtctcctgggagtccatgcttacagtgacagcactgctgagttggtgccatgtcaccagggctgggcctgggcacagagaggcagggtgccagtctttatatattatacatatatatatatatatatat

SEQ ID NO: 2862 - DNA, 168 bp, Homo sapiens
  Genbank Accession No. R45480
tttttttttttttttttttttttgaggctcacaaagaggcctttatttatctagctcaaagtagacactatcacaatcttgtttgttactccttttactaaaatagttcaaatcaatgtttttaccacactatcaaaaagttctatttcttcttgtctccccacggtc

SEQ ID NO: 2863 - DNA, 426 bp, Homo sapiens
  Genbank Accession No. R45569
  unsure (1)..(417): n = a or c or g or t
tttttttttttttttttgatgtcaatgttctcagtttactaaattatcaatgtggaagaacgcatttttgagctccagaccttctaaacattttaaacaggctatcgaagaggatgtaacagaaccctatttcagaaacctaaggntcagggaggaaggaacactgaccggtttttctgggatntttctgtgggggcaacagggatgaacaaaagaaatgttagcatgtcagagcatatgacaagtgaggggagacagaggtaggaagagggttttctagccacaaggctaatgcatttgtgttcaaagagaagtctggggcaaaggaggggaaaccccccctcccccctnaaaaaacaaaaacaaaaaacccntttcaagggacaaaagggtttttcntacaaccccgttttcnaaaagttaaaa

SEQ ID NO: 2864 - DNA, 319 bp, Homo sapiens
  Genbank Accession No. R45656
  unsure (1)..(319): n = a or c or g or t
ttttttttcatggacaggattttattaaaattgtacatagatctcatatttaaattaaaaaatggactttttttctagtatcaaaatagttatttttaaaataccttgaaaaactttaatacaatttttaatatattaaatattcacctgaactctcagccatttatctcccatctctctttgctagaatcttgccttaccatcactatcattcttttgttttttttttctttttgggcatctttaatgcttatcccaggaaaaggcattaaaaataaaatatttttctttaaggtccacaatttaaaaaaaaaangga

SEQ ID NO: 2865 - DNA, 229 bp, Homo sapiens
  Genbank Accession No. R45698
ttttttttttttttttcattataaaagtcagtttattttccctttctgtgtttcgtattttccctttttgtcagtaaatgagcaatacactgactggaaatctgcatgattaaataacattaacaagttcataaacacaccccatatcagagtataaagcaagaggttgaaaaatatcccctaaccgaatgccaaattagggtatccctcaaaattgcacattctccct

SEQ ID NO: 2866 - DNA, 330 bp, Homo sapiens
  Genbank Accession No. R45994
  unsure (1)..(330): n = a or c or g or t
tttttttttttttggtgtggcaacgntttaattctgtggccaggctagccgtctccaaggcctggtggacagcacgtcaccagaggctgccgcagagcaggcagggtcagccctcatagtaggagtgcaggcaaaggcgggggctctgaagtggctgctggaggcaagtgaccccgggctgggagtnctcagtagccntcgttagcccaggtnacctcgtagtcggggtacttggctttgattttctcagttgaaatngcgtgctgggcaggaccataggccttgatggtggatcctgggggcctgaggcgcccagagggacgcancgtg

SEQ ID NO: 2867 - DNA, 432 bp, Homo sapiens
  Genbank Accession No. R46079
  unsure (1)..(432): n = a or c or g or t
ttttttttaatgagtaatgaattattttaacttttatttgattattttcatttacagttctggcactgacactttttttaaaaaaagattttaattttatgtaaagattgaacttcaataaaataacttaaaaaacatttacatgtatatcactaaatctccataaaatatacaatacttttgatacagacataggctagggatgactttgaagggaaatgggtacatattcataatttttaagaggatatcccatatatcggcttgtgggggaataaatacttnatattggaatttgnccagggacatctggaggtatttaaatactattattaacctggcactccgggaaatttaaaatattacnggtttgggaaataccttntattttttaaagggccttaaaactggtgggtttggnttttatccggg

SEQ ID NO: 2868 - DNA, 301 bp, Homo sapiens
  Genbank Accession No. R46337
  unsure (1)..(301): n = a or c or g or t
ccagttccactttttttttatttaaataaccgaagcaacagncgtggcacagcagagggaagntgggttggggcgtntgagaggtggcagcagtntggcctnatggggggantaggtcacagtgaactccccacacgnctntcaggttcagcagtcatggccataggnttgggagcactacggaggagccatcagttagtgatgtctctccaagtcccagagaccttagggacgggagctaagtcagctccctcaagtagcagggccaggggcatcccagtcagggggtcacggnggcccc

SEQ ID NO: 2869 - DNA, 422 bp, Homo sapiens
  Genbank Accession No. R48307
  unsure (1)..(422): n = a or c or g or t
gntctagcaggaaaggagagggagctttccccgaagtncctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctgggaatctgagtattgaaaactgggcttttacttcgcacacctcagcacagactcccatgggaatccagggtcacagcaaagcagccctggggccttccattctccttttaaggcaagcattgacaatcctcacttcactgagtttttatttaaaacttaggcaatgacctttaggaaaggcaagggcattgacctnagc

SEQ ID NO: 2870 - DNA, 233 bp, Homo sapiens
  Genbank Accession No. R48447
  unsure (1)..(233): n = a or c or g or t
gatgnacaagantttttattgcagcattgtttgaagtagtaaaaaacaaacctagaaataacctaaatttctgaaacaaggaggtgagctgaataaataatgtatccattctaaggatactagtatatagctataaaaaataagttatatataaatggattganctggacagatgtccatggaaaaantgttaaggtgaaaagngtctgttattttaatatattacagtacgg

SEQ ID NO: 2871 - DNA, 246 bp, Homo sapiens
  Genbank Accession No. R48473
  unsure (1)..(246): n = a or c or g or t
gaaaataaagcacatttattaaggcaaaggccaagctggcgcttcagaacatggccaaggagcgtgaagggattgctccactttaccaccactcagggcacccaggccccaggggtcctgggtccaccccaggccagcagaagctatgaagnttacgcataagcctggctntcccttttcacgaaggcctgggaagaggctgcccagntcccagagggttggggcccantcgccggccagcagccc

SEQ ID NO: 2872 - DNA, 390 bp, Homo sapiens
  Genbank Accession No. R48540
  unsure (1)..(390): n = a or c or g or t
ttttttgtgcaaatattttttacttnatttgtctcctttcaggagcctcacagacatatccagggaaaaagatcgttaaataaatgccttcagccatcgcaatgcaaaaataaatatcaatcctccagacgcagtagcagccncgntggcnccaaagtcccaacggccacggctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgactcagcgcgggcnccttccccgcacacantcacagcagagttcgcactggggagngttaaaaaataaacatttacaggtc

SEQ ID NO: 2873 - DNA, 243 bp, Homo sapiens
  Genbank Accession No. R48589
tcattttccatcttttttattttaatcattttgtcaaaaaatctgaacatgtgtacataaatacttgatttgttaaaagaatgtgtagcatagaaatccctgagacacattcaaaaatgacttgacatcttgacatgtattcaatgcaagtattcaccaaactaaataccaaggacttgggctcctttccctgatatttgagggcatataaagctttaaaaatatatataatatactatatat

SEQ ID NO: 2874 - DNA, 330 bp, Homo sapiens
  Genbank Accession No. R48594
  unsure (1)..(330): n = a or c or g or t
accacgggacnttttttaagtttattctagggtgagtgggtgcccaaggggggcagttgagtatggccgaggtcacctggtggcagggtgctcagggatggccacaggttctatagggccctgcagctgnaantctctagtcagttgggatgcttcaccttctgccccaccccaaggggtttgggcaatncatggatgtagtagttttcgtaattcgcagggatcagtgatgggcactgagcaggcttgattctcacacacatatgcagtggcctgggtcttccaaccgtcggagggtactcaggaaaggcancttgccggacaagaagc

SEQ ID NO: 2875 - DNA, 273 bp, Homo sapiens
  Genbank Accession No. R48732
  unsure (1)..(273): n = a or c or g or t
gaaaaaagaaatcacttttattggcttggttttctagcattgctggtgcagtgggggcctgagctggggtgcagtcggcantntcantgggcccgtttgggactgggttgagccatcaggccaccgtgagaaagaagcgactaaaaggcactctgggcccagccaagccctgaaaggccagtggcagganagctgggcgngacaagctcttcccaggngacaagagggacaaaccagggcatctaagctntgctgcctgcgccctnccccgca

SEQ ID NO: 2876 - DNA, 410 bp, Homo sapiens
  Genbank Accession No. R49035
  unsure (1)..(410): n = a or c or g or t
ttttttttttgtcgtatattcaaatttatttagatgaatgtccagccacagtcctctgtggatttgtgtacattcactttttaaaaaaatggtttccataaaaggatttttggtaattgcctaatttttaatacagtatttatatacaaaacccacttcaaactacttactgtacaagagaaaagagaagcatcagattgcatgattttagcaaataatggaaatgtacgacacctatgaactttgaccacagttgggcagattaaagggaatgtaacatcacatcantgagatcttcangacaaatttatttctatttttccncctggcctttgctaaaatgatgtttctcttgggtgcttggggaaattttcagaggagttgtttagtatcattgcctgccaaatttt

SEQ ID NO: 2877 - DNA, 479 bp, Homo sapiens
  Genbank Accession No. R49047
tttttttttttttttcagtttttatcattatttattattttattttttatatcccagccctcccatgtaagactggtcattttttagaatcctcagccatatcaaggatacagaaggggtctaggatagagaccaatgaagaaatttctttggagaattgttaagtgctcaattcagccttcttggacaaaggagttactaccttctactttgaaacccagtgaaaggaacttcaaggaagcccttcagagagctttgaaatgtgtttcgtacaaccatttagctggggagcccagagagggctgctgccatgcgatctccctgaaattgtttttttcaggccagggatgtgagaatgtttcctgaggaccagatgtgtgacactcaggagagagccggcataaaatagcccccagaggtaaagaaaacctcaggtttgaggctgggtactaagggttagggaaggtttacaggctttt

SEQ ID NO: 2878 - DNA, 360 bp, Homo sapiens
  Genbank Accession No. R49084
  unsure (1)..(360): n = a or c or g or t
tttttttttgactttattaggnttattataaggagcagtgatgagatctttatcagtcctnantacaaagctttcatctccagccttctccatagctctgtggagggcagagagttgagggaaggaagaatggagcttgggagcatgggatcatgtatgtataccaggaaagaaaacacacattctttattctattgcttcaangacagtttgtgagantggangataacaagcacagctggaccaggaaggcagggcacacatngcaggtcaaggttcctgctatccagggaggtggcccagagcttccctggctgctcctggnggaagcagantccaagctgggcccagatgaggccc

SEQ ID NO: 2879 - DNA, 454 bp, Homo sapiens
  Genbank Accession No. R49216
  unsure (1)..(454): n = a or c or g or t
tttttttttcagaaaaagaagtatttttttaaaaaagagagaaaagaaggtgaggagttcagtgtaaccaggtgactactctgaactggggactgagtcagcctctgacgctgagctgaatgcccaatgacaaacgtgaccagccgtgcgngcgngggcaaggccaaggacacagagggccgaggcagngngccaggntntggcgcttccagacgtttctactctctcattttattcatggcgacttgggaaggaaatctgtctttaatgagcaaatgtaaggctgcgttttctttgcgaagtcttccacaggattttcacggcaaaaccaatgaggaaaatgtcctttcaaagagaaggaccgagtntcccgaggaacatttttcttggaaaggcgcgtgcacgggccgcccttttcgagggcttcgtaatgtggtttcaaagaacattggtt

SEQ ID NO: 2880 - DNA, 444 bp, Homo sapiens
  Genbank Accession No. R49395
  unsure (1)..(444): n = a or c or g or t
ttttttttttttttttttttttgcatatttataactgtttaataaactattcaaaattagcatctaaaataattatactttggacacacgaaggcatatatttggngagaacattgtaattttcattttgtaaactatatattctatattcaagtaataacacagcattgcctatacagaactgaggcctgcgctgagacccaaaacttgtcttttcctaaatgcaccactacggggggctantangnggtctgtccagatgctaagaccaggggacttcaaaatctccatcctgcggctttacaggtctccggggcagttagganctttatctttcagagggtgggagggggcctgacaggnggcttttggaaaccttttgtggcaactcctcccgggggcacattttgggggnctcagttccaacccaaatgccttttttna

SEQ ID NO: 2881 - DNA, 425 bp, Homo sapiens
  Genbank Accession No. R49459
  unsure (1)..(425): n = a or c or g or t
ttttttttattgatatcaggtggtttattgatattgaaactccacgcccctttcaccacagaccacctgttggccataaggctatggtgccagcgatctctcccactaacagagctggccaggtcccagggcctagcaaacctcccagagtggtctctaggtatggaggaccccagaaaggggaaggggctgtgattgaagggatgctactctctgattaaccgacagtatgaccgtcacattagggtcagctacactgcagggctggggtgtgtggatatctgtgctggggtctgggctccgtggagagatgtgtaggggtaatgagaaattgatcagcaatgagaggtggactctgagccacctccctgaccctgaantcatttcaagcgaggagcagagggagctcttgacttgggggacgg

SEQ ID NO: 2882 - DNA, 324 bp, Homo sapiens
  Genbank Accession No. R49476
tttttttttttttttccaattcatattcagccagtgtttattaagagcctactacacgccagacactttacatgctgatcacatttactcctcacaaccatcttgtaagggagacatcatcagtgccatttgaacaaatgaaaaactgaggctcagagagattcaataccttatccaaagctctccagacaataagtgcaaaaacaaggatttgaaattcaggactgtttgattccaaatctgggaactttctgggaacctctgacacacacacacacacacacacacacacacacacacacaggcaccatgtcctgagctgct

SEQ ID NO: 2883 - DNA, 395 bp, Homo sapiens
  Genbank Accession No. R49482
  unsure (1)..(395): n = a or c or g or t
ttttttttttgcacatagaaacaagacatccatgtgtacagtatcaaaaaatatataccaaggttactggtattgcagttcgtggaaggggaagagaggggagaaaatgaaatcaaccgaaatactggatggaggggaagaaaggtcaaaagaaaatagtttgtctgatatagattataacatgntctagaggaaactccataaatctaggtttttatatttcantatataaatacctacaattaantatatatataggcagcccgntgggngttggntcgggccttttgagnctcaaacantacattttcaatattaacaccacgtacaaacggggagtaggagttcggcactttggacaaggttaggncacgggtttaaatttttanttactt

SEQ ID NO: 2884 - DNA, 445 bp, Homo sapiens
  Genbank Accession No. R49602
  unsure (1)..(445): n = a or c or g or t
tttttttttttaatgacatgcttatacatttattaatcatttgtatgataaaatatatatgaatttacatctttaatatgacataaggaattataaggaatattatgaagttaaagaataaaatataattattgatacactaaaatccaagattcattccttattttaaaaaataacaataaacaagagtaaaaggaaacttatttaatttgataaggcgtatgtaccagaaatcctgtatcaaggcatcatactaatgggtaaaatattttgttttaattgttaacattttaaatgtatttaaaaatggagaggggtttctccntgttggccgggntgggtcttgaactcccggggtttcaggtgatctgcccncctcgggcctncccaaggtgcgggggattacggggctggaccttgtgnccggggcctttaacggttaaat

SEQ ID NO: 2885 - DNA, 397 bp, Homo sapiens
  Genbank Accession No. R49708
tttttttttttaatgatgttcatttatttaaacgatctgtatgaatttggtgattttgtggatacgcccctgacagacaaggattcacagccgacggaagtcagggaggctccctgcaaattcttcatctccgcggggcctgcccgagccctgatcctgcagagccgtggggctgaggtagccgccggttgtggtccagggagtgcgtctttctggatgcggggcaccttcatttcaccgtagcaaccgggtaccaaaagtagaagcggatttttggaaaatgagtcattaggtcccaaagagaacctattgcaacatgggactccataacgttcttgaggatcatcctgaggaaactgatgttctctcgttagacaaaaatggcacgattttgctt

SEQ ID NO: 2886 - DNA, 392 bp, Homo sapiens
  Genbank Accession No. R50008
  unsure (1)..(392): n = a or c or g or t
gatccccctcccctgcctgctctgcactcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctgcgaaagaattttctggcttgccctgtgactgtgcagactctgggctcgagcaacccggggaacttcaccctcagggggcctcccacacctttttccagcgagggaggtctnagttcccagctttggggaagg

SEQ ID NO: 2887 - DNA, 497 bp, Homo sapiens
  Genbank Accession No. R50692
  unsure (1)..(497): n = a or c or g or t
gaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaattgcctcacccacccaggtcctggacctgtggcaattaagggnttgttccctggcgaagtttttgttgggatgttaaatatagtaaaaggtngcttctgtctttttcaaaataaaaaatt

SEQ ID NO: 2888 - DNA, 381 bp, Homo sapiens
  Genbank Accession No. R51256
  unsure (1)..(381): n = a or c or g or t
ttttttttattttttgttgaatttattaataatctttatatatatttatatatgtatgggctttgagcaaagacaaaagaaatactctaactcatccctgatcatacagttgttgtaagaatcagctattctattatctttccagcagcagaaagaccaatgaataatacatttctttctgtacagattaaaactccatacatacggggcttcactatgtacagaggaaaagagggtcactttttcaactaggcaatgggacctttatattacngggaatgtgaggtcatttttttttctttaatctaaggtatatatacattcctaacatatatggatataatttaccctgtacccttttattagnttaatatataaacc

SEQ ID NO: 2889 - DNA, 371 bp, Homo sapiens
  Genbank Accession No. R51309
  unsure (1)..(371): n = a or c or g or t
ttttttttttttaaagtttaaacaccttttatttgaagaaatattgcttctagnactttcctgaagccagaattgttctataaaagtatcatggaatattatacatgattaaaaaacagagtatgcttcctaataacttgaaatctttttacaaagcacattattcatgatcataaatatgtttgttctgtcatcccaccgatgatacacacatcaggcaagcagctaatttgaacatatgtacagagtctatgataaagatttaaagttaccaaaaagattcaggctataacatattaaattttctttaaaagagtttaccntaaacacttaaagganaacatagtttatctaggcacttggagttatct

SEQ ID NO: 2890 - DNA, 414 bp, Homo sapiens
  Genbank Accession No. R51831
  unsure (1)..(414): n = a or c or g or t
ttttttttttccattttaaattattttattgtatattaaaaaaccaaataaagcaataactttaaagacctcacacacacacagtataaacacctgggtaaggttttnttcgtgtccatgttgacaccggaactaccgttaaagtgcaagttttgttttgtgttcctttgtgcagtttcactcacatgtaaacaagtcacttggctatgatttgacccacgcccccccgnttagtttcgggagggcagaggctctaccggctgtcacagcaacccggantcacagncaagntaatgccccgtgggtcctgaccctgcaagcggggcatgacggtttcttgangcctagcagaggntggttaactttcacatncctcccccaccccgtggttcactnttaggtttttgagaagtt

SEQ ID NO: 2891 - DNA, 427 bp, Homo sapiens
  Genbank Accession No. R51908
  unsure (1)..(427): n = a or c or g or t
tgttttagaataaaaacnttcctttaatattgtaaggggtactgcaggtatgccatgctgccagttattnctggggcacaaaacgccccagtcagtcattcggagggctgggaaaacgcataaactcataatttcagagcaagtagaactagtatttncagtttnctttcttggaaattggcccgggacatctccaacagtctacacatgtattgccatggtacttgctctgatgctctgaatgcctcgggaactgtgttcaatatcatggatttgtggggtcctctaaaaggttttgttgttaacatggcaaggcaaacagcactggaacaatattgtctaaaactatgggctggccaaggtactgggatnctttcatnaatggaaacccaaatttaccaaaaacattggcnttgttggggggttt

SEQ ID NO: 2892 - DNA, 456 bp, Homo sapiens
  Genbank Accession No. R52161
  unsure (1)..(456): n = a or c or g or t
cagccaagagttctctttattccctttgatcctcccccaaggtgagggcttaggcagctgtagaaccccaggaaagaacggaatccaggcaatctgtttagagaccccccactccaaatttatccttttcctttccttcccctaagatgtttccagggccctctggtgcccacactgtcctcttccttccanttgggggtggggaaatccttcctgcgaggtcagggcatttntntacaaagtggcctgaatgaggccagggcctgagaaggagccaccagntgggaggaaaggggntccaagncttgcttttaacacccctggcaaaacccccaccctnccaagatttttcacaaaagggtnaggaaattcagggtacggnaaccattcaatgggncaactttggaaaatngcatttttcctcagggnctttggcagtttccccggaggtttttt

SEQ ID NO: 2893 - DNA, 411 bp, Homo sapiens
  Genbank Accession No. R52649
  unsure (1)..(411): n = a or c or g or t
ttttttttttgagaggttccaatcaacatttattgccttattctttttatctcattcctttttgaatgtgtttatctcctaagattttatctgtgatggagatgggatgcctgtgaatacaaaagttgcagtggtggcaccagggtgggggggtgcggccggggccaccatggtctcccctgagagggggtgctgtcttaggtgccccaagaggccctcgggcagcaagcgtggggtgctgccaaaatacagctcccctgggtgggcaggacacacgtggcctcctggcagacaggtgcctgggtgagcccgctgctcctgattagtcatgaatggcacctgggtctgggcgacagtcacccgcagnaagccctgagctggccaccatcaccctggggcagttgcttcccg

SEQ ID NO: 2894 - DNA, 598 bp, Homo sapiens
  Genbank Accession No. R52800
  unsure (1)..(598): n = a or c or g or t
tttttttttttgcaaggtaaaaggaatgtatttttattttnatttttttttttttnacgaactagatgtaaacctttacgtcacaactatgtcattttcactttctgaaaagacacggacccggggacacagctgaaaacagtgggaggccagatgctggcgtcttccaggcgggaacgtagccatgatcactctagggccgatgtctcctggggctctccggcagacaagacaggtgcaccgggtactgtgcaatcccagttttacttagagccacctcttgtttgggggggcattagtcctcatttcatgccagattttcactagaggctccctgttcttccaaatcagttcatgagggtaagtaacataccatattccaaagagagctcccccaagatgtnctggcataattcaaaaaatttccgtcccgggttcattcccngccttntccgtgggcgttaatgggtttntaggggcntttccncgctggtgaatttgnactttgggagtaattattgggcaggctnccttttggggttcttaagtncgggacagtttncggaggntccatcntgatggggcncgagttgcacca

SEQ ID NO: 2895 - DNA, 226 bp, Homo sapiens
  Genbank Accession No. R52822
  unsure (1)..(226): n = a or c or g or t
ttttttagttgtatatcatagaacctttattatttatcctctaaattttttagaaacttacataacgcccgtgctctagttatgacaccatttatagacatttaaaatgcatcttcatttataaatattttacatttggnccatagaacagataattttactaaataatactgtattttttaaaacaggctctgtatatactttgaatatgtatatattacatata

SEQ ID NO: 2896 - DNA, 379 bp, Homo sapiens
  Genbank Accession No. R52949
  unsure (1)..(379): n = a or c or g or t
cacttggtataanttttatttgcatgtgtaaaaagtgtatataacaggaaacctcttaaaataaaaacatagtaaagttttaggaaaaatatgaatttagaaaatgggttgctttttcagatcacaaaaatactgatatatgtgtactaaattaccttaaactgttgaggtgttagagaaacatttttcaaaaaacaaaaaaagttggaggttggaggagacacaaaatntagangantganggtactgatatatgtcacacatgttttaaaatgaccacacagggcaggantctacaaanggattcaaattctttaaaattacaggnattgctaggaggattcccctaatnggtgttaatgggccatacntaacnttc

SEQ ID NO: 2897 - DNA, 362 bp, Homo sapiens
  Genbank Accession No. R53044
tttttttttttttggagtaagtagattctgagtttattgttaagatttctttatttacagtacaagtctccaaaagttcaaggcagttatcttttaaataacatgtcaatcatataaaatagctagaaccaaagtagagaaatatatacaatacattaagtactttcaatatagtggcatttttcatattaaattaaaagaggctactatgatttacaatgtcatttccctagtttaaaattcaacatgtcaaaagacataatgtacattttttacaaaactgacacagcagtattaaaactgctaatgcttgtagtttttattttttctataatacactggcacctgtgttaccaaaaaaa

SEQ ID NO: 2898 - DNA, 322 bp, Homo sapiens
  Genbank Accession No. R53109
  unsure (1)..(322): n = a or c or g or t
ttttaaaaggtcaatttttttttattggttctgagagggaggattcacccagtggatccttttccctacactctcccctcccccaatattgaggctctctcccaactactgcctattcagcattctctatctaaccctccttccccttctacttcctatactatcctacccctgggccagcagtaccccaaggccaggccctcagctgtgggggcgtgtgctgagcaccaagcagagggagctgagcccggcgccantttctccagttctgagcaggacacagggtaccaggggtgacatcagagagcttctgcagtgcctc

SEQ ID NO: 2899 - DNA, 279 bp, Homo sapiens
  Genbank Accession No. R53891
  unsure (1)..(270): n = a or c or g or t
tttttagctttaaatattttttataattntgaatcatcttgtattctatcagataatacttggaacaaaatcttatttcaatcagctcaatctatacaagttataagatgcaacacaatgtaaaccctatagtctacagaatatgcactatttaatactcattaactaaagaaaagtcaatgaagattaccaaataggaaacacaaagcattctaaatttttaaatcactttagggtagctaaccagaaactacagaaataaaatatgcacgacaaaaa

SEQ ID NO: 2900 - DNA, 442 bp, Homo sapiens
  Genbank Accession No. R54416
  unsure (1)..(442): n = a or c or g or t
tttttttttaatagagacaagttctcgctgtgttgcccaggctggtctcgaactcctaggttcaagtgatcctcctgccttgtcctgccaaagtgctgggattacaggcatgagcgccacgcccagctgagattacattactttgagtgtttaatttcactatgacaggaagtagcctaatacatacttttttgtgttaattttctgggattcatcctggatttttagtcttcgtacctgagtacaacaataaaggaaatcacttcttaggatacattaaaattacttctaaacttggccccccacacatggaactgttttcagtttgctatttttaatgggcccatggcttatttatataggacataggcataacactggcttaacactttatgggcctactgttcctctttcttngggattatattnttaaaaagatttt

SEQ ID NO: 2901 - DNA, 364 bp, Homo sapiens
  Genbank Accession No. R54614
  unsure (1)..(364): n = a or c or g or t
ccntgccaaactttattgtgattaaaattccagagacagtaccagctccacatacctctagccctgtctttgccctagttcccgagtgtccttcacccccatcttccaaatcatctctgggtttcacggggaagaaaaaacctagggctgctgtgaatgtgccctntcaggtccctgaggttggccccagggtagancnntaaggagntcagggaagagggccttcctgccttgacggnnnangatcctgggnggcaacgtttnggagcagaaagagaagtcgaggtagtgaaagggagtcaggccttgggagggatgccccacaantccagcagcntcgagtnttgacgattgcagagtcagg

SEQ ID NO: 2902 - DNA, 397 bp, Homo sapiens
  Genbank Accession No. R54935
  unsure (1)..(397): n = a or c or g or t
ataatttttatagnaaattttattcaacatacaacattttccagcaaaaaggcaatatacaggaagagttggtgtacactgctcccacagaaacaacccaaaaaataccggaaaaggatgaaaaataagagtgatttgctgattctattttactgcactcaaaactagacacgcagctggcattagctccaaaataaaaggaaacggggctgggaccgaaataaaactacacacaatgantatcaacatcagtgaaattcacttgcagactcacccaacaaaaagggnacctcctcccgtgggcaaattggtacatgttcattcattnaatattacaattcctttttccttttttttttcttttttaacttttttttacaaggtcggccggcttact

SEQ ID NO: 2903 - DNA, 292 bp, Homo sapiens
  Genbank Accession No. R55470
gtggagcaggaggttttattgtaaagaggccgattgtacagagcaaagattgttctgacacggggggctgggtggtgggacccagaggccagagctgggtgaaggatgaggggtggcatcgcccatccaggcagtgggcagggcagggaggactaaacggctgcctcccagttcccttccctgcccctcattactgggtaagagggagccaggctatttccacggatccaggagaatatagcaggagaccctcaccaccccacaccatgccccaaggatacgggaggtgccc

SEQ ID NO: 2904 - DNA, 440 bp, Homo sapiens
  Genbank Accession No. R56094
  unsure (1)..(440): n = a or c or g or t
tttttttttttttttttttcacttctggagtcatttattgaaaaaaaagggtgaaaaccccaaaccagagtaaagtcaaggaacaaatatctgctgtgccagctgggtgcagggatagatccactgaagagtgggagaggaggtcagagccaccttcctcatcacccggttcgagcagantagatgagtggagagagccatgcaaaatcagcccctagnagantgcgagcggcacccggggaagatgcctgctgtacagtgaggagggttttagggttttgagcatccccatgagtccagtttttcacaggtagggggtacgagggtntacctcagaggtcacgggcagccttccacataggggtagcaggccactgatgttcattaccntggtcatttcgtttttccntcctttttccgtcatttgcntttaatttttt

SEQ ID NO: 2905 - DNA, 390 bp, Homo sapiens
  Genbank Accession No. R56095
  unsure (1)..(390): n = a or c or g or t
tttttttttttttcaaaggcaaataaaataagtttattgggatgtaaccccatcataaattgaggagcatccatacaggcaagctataaaatctggaaaatttaaatcaaattaaattctgcttttaaaaaggtgccttaagttaaccaagcattttgataacacattcaaatttantatataaaantagatgtatcctgggagntntantgangnaacatgccatgtgtataanttcagnantacgctttttacacaanggaactacaaaangttacaangacagccttcgggaaccacacttaggggaaaagtgaggccgagcagcctttcacggcaaagcctccttccaaggaggtctccccaanggcttccggaaccngccgggtt

SEQ ID NO: 2906 - DNA, 364 bp, Homo sapiens
  Genbank Accession No. R56602
tttttttttgctgttatgattagatatttattgagcaccaggagagagtcagaacattagacttatagtggaggagcagaactgaaccctggcctgtgaaataacaatttcaattaaaagctgtctggccctgaagaaagagaaatgatcctggatatagctggtcctctgagctggcagagctgagcctccctcgggtcttctggtgggcaagatgccaaagttgaatagtgtctgtagggcatgatgaccaagtcctagtgctatgggcatcttccctctggtatttaggagaggagtaccagaagcccccggcagaggatactaggaagggcccagagccaaatccagcagctgggcttac

SEQ ID NO: 2907 - DNA, 371 bp, Homo sapiens
  Genbank Accession No. R56678
  unsure (1)..(371): n = a or c or g or t
gtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaaatttaaacttagctgggtatggtggcacatgcctatagtctcagctacttgtgaggctgaggcaggaggattctttgagcccagggagtttgaggttacagtgagccacaatcacaccatncactngcactccagcctgggc

SEQ ID NO: 2908 - DNA, 365 bp, Homo sapiens
  Genbank Accession No. R56880
  unsure (1)..(365): n = a or c or g or t
ttttttttttcgctgggagcagatgagtttattgggcacatccctcactgaagggcttgggtttggtccccagcagtgcctgttctggggccaggcctnccagtcgtgtgcccaggctgtggtcctcaggaggccctgtcttggagctcaggcacaggtctgggtgcatactcctcgctgggggtgctggccggagccttaggcaagncttcaccagggcggcccagggcttcagcagcccttcgtccgcacctcgggggccgggtccttcagcaggatctggagcgccgcaatgagctggtccaggtccacctgcggctgctgcctggggtttccgagtgcagcaccaggaacccggtgaacag

SEQ ID NO: 2909 - DNA, 420 bp, Homo sapiens
  Genbank Accession No. R58974
  unsure (1)..(420): n = a or c or g or t
tttttttttttttaacagagtctcactccattacccaggctggagcaagacttccactctcaaaaaacaaaaaaaacgttttaagcttttttttaacagagtaaaatggccttttaaagatatatcaatcaatcacagtgtactgcctttatttggatcctgtttcaaatgaacaaactatcataaaatcaatcataggaagtgtaccactgggaagggtgttcctaaaggagggaagctatgcaaatgtggggcaaggggaaatgcaaattctcagtgccttctggctcaattttgcctctggaacctggaaactgctgttaaaaaaataaaggactatttttaggaattggggaaataagganaacaatggaccttttttgaaaaattgggggaaatttaaacccctnttttaatagt

SEQ ID NO: 2910 - DNA, 401 bp, Homo sapiens
  Genbank Accession No. R59093
  unsure (1)..(401): n = a or c or g or t
ttttttttttgatgtttaacgtgtgttttattgttgttggcaccagaaaagctcatgttctatgttatgtcactgtacatactgtaaacaagactgcattaatattgttttcttatgatttgtttcaatgactctagattttaaaaaatacattcacaaactaccttatgtttaaacacaatgattcccttttatttcttaactgtacccaaaatcccacaataaaaaaatcatttaaagctgtgtgtttcaaacttatcacttaggaaataaaaacaaaacaaaacataaaaacaaagntcagtttgncaacatantttaaggaaggcttctgggtttaaaataccacggcggcantataaggggcgggtgggncaatcacattcggggaggtggaaatc

SEQ ID NO: 2911 - DNA, 383 bp, Homo sapiens
  Genbank Accession No. R59221
  unsure (1)..(383): n = a or c or g or t
ttttttttaggatggggtgtctgagtgtctatgtgagggcaaggacaacagtgcagtccagaaacacagaaaatatgcttttttgcagctgagctctgttttgagatttcattttgttactggacagcgcttaatccataccaaagtctttggaacactgcagatttgctttagaggtagataaaacagaaatcatgcagttaagtcaattgaggaaaaaaaaagggatttgttgtctttacagaacatcatgactaaaagttgatcctttgctcttggtgcacatttaagatttttacctgttttgggnaatacccaagtcttccttgtctctcaggnaaaacacattttaanttcatcctgtactaactacagataggagg

SEQ ID NO: 2912 - DNA, 536 bp, Homo sapiens
  Genbank Accession No. R59312
  unsure (1)..(536): n = a or c or g or t
ttttttttagattcagatatttaacgaatagtattgcatggtacaatcatgcaggtttaaaataatagcaattgagtccataggagaagacgacattcttgcttgacaaggtaggaacaaattcattatatttcaccaagactaaaattacaaagtttgggtgtgtaaaggcaagatttaattgttgggaaaatttatccgagccagccaccacgacaaaagccaggctgaccaaatcaaatggattctttacatcctccaagtttcagaagaatcttgaatatggttagccagaagatatggtaaatttgaccccaaacatttgcttgaaggagtaaggtcttctaatgagtgaatgtcaagagatcagcacataagtaatagcttatttatcctttaggtcacatccatctgtggaatcaagcagccttggcagtccacntggtcagctntctccctggctcgaggctcatggtccaggtntttagccgtcttagggttttaaaagccctcctttttttttgggtgttttagag

SEQ ID NO: 2913 - DNA, 423 bp, Homo sapiens
  Genbank Accession No. R59325
tttttttttttttttaacacaattttgcatcttatatttattatatactgtattcttataacaaacaaaatagctacagaaaagaaaatgttatttagaatatcaaatggaagagaaaatatatttagtattcattaaatggaggtggatcatcataaaggtcttcatcctcatcgtcttcacattgaaaaggttgaggagaaggaggaaaaggagagttggtcttgctatctcaaggctaatagaagcagaagaggtggaagcggaggcagggagaggcaggtacactcaatgtaactttacagaaatacatcgtaatttctgtctgaatttttgccttctcatttctctaaaaatgtttctgtataatacaaatccttctttcactatttgccctagtttcagtgcccacatccttaggaa

SEQ ID NO: 2914 - DNA, 354 bp, Homo sapiens
  Genbank Accession No. R59352
  unsure (1)..(354): n = a or c or g or t
tctttttttggggggcagcagttttcctttttttaaacttaaataaattgttacaaaatagactttagaaaataagttacaaattntagcaaaaggctcccttccacaggcaacttncccaccggtggggctctgcatccgcctctccctggngttgcaatctggctgctgagggtggcgctgagaagagcacggtgatgaggctgggggaaggaggtccttcaaggacagggacgcgaggaacaccccaccccctccttgggaaagcaagccagatctgggtccttttcacaaggggagaggagaagatatggggatgcccganctatttcctgcagnaaaatntgggagatc

SEQ ID NO: 2915 - DNA, 268 bp, Homo sapiens
  Genbank Accession No. R59722
  unsure (1)..(268): n = a or c or g or t
tttttttttctctctgaagcatgtttttatttctctgtgatttggttttctactttggtacacatgagctgtggctgcatttcacacagaagctgacacatctcgcaggaatgccccataaaacagagcgcaaacaaatcacccagcaggttcgcttcacctgggctgttactgctgaactccctacttctaagagcacaggaagagnaacatcgctttgaatctacaggataagcgagggtggggcgagcagcagccaggggctccc

SEQ ID NO: 2916 - DNA, 418 bp, Homo sapiens
  Genbank Accession No. R60368
  unsure (1)..(418): n = a or c or g or t
cgtgtggcttttccggataccaggaaaacatactgctttgatgctttccccagcattgacaagatatctaaagtcacctctcctgtgttggtcattcatggtacagaggatgaggtcatcgatttctcccatggcctagcgatgtacgagcgctgtccccgagccgtggagcccctttggtntgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatggaagaagtgcccaacctttagggtgttcntaatcaaagagctggatgg

SEQ ID NO: 2917 - DNA, 423 bp, Homo sapiens
  Genbank Accession No. R60512
  unsure (1)..(423): n = a or c or g or t
tttttttttttaactcttgtcaaaaagatttattaacttaaaatagaagtacttcaaatacagacaaaatcaactttccattcaagtttgaatgttcaatatacaagtatggaaaagaaaaaaaatctgaatcttcatgttgtaattttattttatttttttaccttttaaaaagtttttggcactacaaggttctgtaaagaataggaagtgacaatttaaaacacatggaaattctttcctaacttttaaggancaatatataanggcctggaaggcaaccaaaggtatggaatacagctaataggaanataaggnatggtaatttttttaaatttctctctttatacatttcatcaggggtttaaacaaaacataaaattcccttaaaatgggggggnattantcgggtgggattttggg

SEQ ID NO: 2918 - DNA, 459 bp, Homo sapiens
  Genbank Accession No. R60959
  unsure (1)..(459): n = a or c or g or t
tttttttttttcatgtgaataaaatttaatgttgtcataaattttataacaaagttaatctgacacatttaatnacnacaantgtgtaatatacaaatatacacaatcagacattgataataagcagttcacaccagtgactgtaagagtctttacttgtgttcagccaagccaactgcttggtatatttttctcccttcttagtcgttagttttccatacctacaataactatcagtggtgatgggcttctctgaccatgtgaataatttaatcctcaatgcacaggatacaggaaacccttgctggaggacagtgtgggaggcaggaggaagggctgttctccacttccttccacctggaaacacctctggcagatgggattngggggagnctctggcctaacaggcccttggggacctaaaccactttcagtgttgtttccagtggagtgttnggg

SEQ ID NO: 2919 - DNA, 476 bp, Homo sapiens
  Genbank Accession No. R61297
  unsure (1)..(476): n = a or c or g or t
ttttttttttttgaatcagtcaattttattccaattcttcacaatttacactcaatatgttgtttccaaaatgtaagtcaccctttatataatagttttattatttcatctttcttttagagtttttttaaaatctttnccttatgtttcttcagtagaagccagantcttgagttgcccagttaggagcctctgacctgctattgtcattaagtttcttctcaatattcatggccaaaatctagcttctaaaagaaaggcttttggtcttttcaatcacttgctgatagggtgagagtacattgttaccataaccacatgacctaatttaggaatcaatcttgggcatccagtcttggcatttctaatcacatttacaatccacctttcaggtttcatcgggagtcatgttcaatttgtctgccaacatgttaatgctgatacacggggggntgtgacggaagncccaatttgga

SEQ ID NO: 2920 - DNA, 434 bp, Homo sapiens
  Genbank Accession No. R61374
  unsure (1)..(434): n = a or c or g or t
ttttttttttttttttttactttgttctttcttttttatttagtcacaacacatcagtacaacagaggtcaaacccagttcagtggaggtcgtttaactacacctgctaaaagaataaacctgaaaaatgatattttatagcccaaatcaaattaaataaatcaaagagaaggaggcaggaaagcccttttaaataccttggcaaccacagttccatgcaccaaaaggaaaactcacataaaantttccagttaaaagaaaatatgggcagtcccgggnaaattaggttatgcatttaacagtttccactgtactacttcaattgaccactcggcacaccatgatcacttatccatgtttaacatttgtgaatttgaggatccgtgtgattaaaaaattctttgtgttgctgggggctgggtaaatgcgggcgt

SEQ ID NO: 2921 - DNA, 286 bp, Homo sapiens
  Genbank Accession No. R61557
ttttttttaaaatatctttttttttctctttaaatcattttgccattctccagggtatatcctacggggaagggtaggggacccatggccagccctggctcctactgccatcctcccaagtgaacttagcacagagactggggaggggttgaccccactccagaacaccaatacctctttcaaacatgacagtggagtgaggatcagaggatcagccccctcccgtttcctgggcacagaggaaggacagttacacttaggaaatatatatataatatatatatat

SEQ ID NO: 2922 - DNA, 464 bp, Homo sapiens
  Genbank Accession No. R61740
  unsure (1)..(464): n = a or c or g or t
tttttttttttttgatgtccagaatttattactcctggangaacagactcaaaacgcaggtgagagccacacaggtttccaccaagacggatggagggggactcaggccaggggtggaggctgcagagtggcaccggtgggcatgccaggcacctcaggntttctcatccaggcntntcctgggctntgaaagggaccaggtagcccctcccatgccacacgtggccttccaaaggnccagatatntacagntntacagacgtgcactccctgggtcccccggcgaggtccagggttacaggtttttacaagaccaaaccttcacggcaggccttttcanttgttnttcagcattcctgggaccaggggcacaggacggganaggccttgcccatttggcccccagcagganaaccacaggcagaggttttccacggaacccttgaggnacattgcctttgagg

SEQ ID NO: 2923 - DNA, 356 bp, Homo sapiens
  Genbank Accession No. R62173
gatggagaaaattttatttatgtaattttcatctgtagagatgcttctgtcctcatctttatatttgtctccctcttctcattgaactgcaaaattcctgaaggatgagacctgggatgtttaatgcaaaccgtacattctcagcagagcacaagtatcaaagggacattggatatattttaataatgatctaacacaagcaaaaataaccactgaaaatataaaactcaacaagagacataagaaaaaagcagacagaaaacaaaaaaaattcttattttaggaatgatgctatatgtaacttgtaaaatatttaagtttttatacatgaggttatattgggtttccttatttaa

SEQ ID NO: 2924 - DNA, 339 bp, Homo sapiens
  Genbank Accession No. R62456
ttttttttagtctttaattcacttttaatagtataaacctcatttaggtagtagtattaagccacaacaataatgccacattgaaacagcatttaataaaatgcataaagctaattcatgcactgcaatactctatatacaaacacaacaatgcaaattcttcttcaagactgaagacattgattagatataaaattcagtttaaaaaggaacatgctattttttaaatgccatcacataaacaaagtgatttcacagggagaaggaaagctgtataaagctgcagctttcaacaggttttaaacctggggcattaaaatgtaatgggcaaaaccaata

SEQ ID NO: 2925 - DNA, 275 bp, Homo sapiens
  Genbank Accession No. R62519
  unsure (1)..(275): n = a or c or g or t
naggcactcaatatttattgaatacatggatgagttcttcctcccccatcttcccctgccctccactccccagctccaccttccacctgcccttacctgccaggggctctccccccactggaagcccgccctccagggtncccccaaggacctcatagggagccaggggggcaggggccggggggagtttcccatagtntacgagccatcccagcccactagctgggagcagggccctgtccagntccagccccagggttcgccagggagtnaca

SEQ ID NO: 2926 - DNA, 403 bp, Homo sapiens
  Genbank Accession No. R63545
  unsure (1)..(403): n = a or c or g or t
gagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccagggctcgacttcaggggtcagtgttcctgtcccaaaccccacacagaatactctggcctctggctttcatgtaggccaaatgaggcaaaaaacttcagtatctattcaaaagtggtaaaattattatttccnatgggc

SEQ ID NO: 2927 - DNA, 443 bp, Homo sapiens
  Genbank Accession No. R63734
  unsure (1)..(443): n = a or c or g or t
ttttttgatttttgccttttnatgcctacagtaactgagaatcaacaaagtaactagtctgacatgaaaaatgtggtgcctatgatttaagtcctgatttgagcacatcttaattggtgcactattgcttttgataatccagatataacaacagacaagcagtaataaatgaagagacttactatgtatcacacaagcaaggtttctgaattacaaataacttcaacaatgacatcaaaacctatganttaaatcttaactcacgcggttataaagttaaattctcatgtgtcttagtgagaatgctatcatcaaatacattctaaattctttcattttttaggtgtacaaaggttatggggnggaaagggtaagggtgctttttaaataaggctaccactgactcacacacatccctacacggcttcagggcaanctttgga

SEQ ID NO: 2928 - DNA, 351 bp, Homo sapiens
  Genbank Accession No. R63925
  unsure (1)..(351): n = a or c or g or t
taaaagttacagttttattttctccatgtttaatactgttaatatttgatagggtattagtatggtgggtacgaagaactgagcctagtacttcacatgaaatgctttttgcatagtcttcataggtgtaataaacagaatcatgattttcatgaatcctatctccaccaatatctgtttggcaaaaacattcagctggagtacagcctccaagaggactaaaagcagaggatcgaataggactaaataaaccactatcttcccttgatgccttcactgggcgaggagaatccggagcatcacacaggttaccatatgggagattctgggtttacgggggngttgggcttt

SEQ ID NO: 2929 - DNA, 323 bp, Homo sapiens
  Genbank Accession No. R64131
  unsure (1)..(323): n = a or c or g or t
ataacaatttatatatatttatttatgtattttatatatttataaattttatttataacaaattatttattaccaaaaatgaataactttataaaaatgtaattataaattaaaataagtatgtcgattttatttcttacagtcctgaagactggaaagtacaaagtcaaggcgctcacatctggcgagggccttcttgctgtgtcatctcatgttggaagggtaggagaacacatgcacatgtgcaaaataagccaaattcatttttataacaaaactatttcttccaataatggaanttaattcatttatttggggcagag

SEQ ID NO: 2930 - DNA, 229 bp, Homo sapiens
  Genbank Accession No. R64137
  unsure (1)..(229): n = a or c or g or t
ctaaatattnttagtttattgaaataaaatataatctataataaaaaatactacaggtgttattcactggttacagttttaagtatattaacaaaaacagccaacattttaacccaacaatgacactatctttgtggnacaataacaaacatgaaagtaaatgttgaataatactgaataattctgtcaggaaatattttatactttaccatctatgtatgccttttaa

SEQ ID NO: 2931 - DNA, 446 bp, Homo sapiens
  Genbank Accession No. R64144
  unsure (1)..(446): n = a or c or g or t
aatgtgaatatnncatatttaatgtagttctggtgatggctacagtcagtagatctaccagcaatttgtccctttttttgtttcagattttaaggcagaaactcaatctcagcagctaatttcatccaattttcttcagaaacattctccaatttagttgagtacgcaagaaaagtgtgtgaacattcactcctgtcctccccacatacatatataggacatacaataaggaaacatacatacatatataccctaggattgtcaatgtatggctgctggaaatgccnggaagggttacttttcactttaaaaataaaatttggtgggattattctgcaggttgggggttgggcccctggccaatttttataaatatgggttgngggggccggccaccagggttttacncggggggctgtcctgggggggttnccccgtnggggttt

SEQ ID NO: 2932 - DNA, 479 bp, Homo sapiens
  Genbank Accession No. R64199
  unsure (1)..(479): n = a or c or g or t
agatgaatattttttattttgaaatttgagaatgtcctaagaggatgtctacaggatatgaaactactgggtgcaggaaaattttttaaatgttagcaaattgtggcaagaggaaaacaaacagtggagaaaactgtggtagagaaagtaaagaaggggcaggagaaagctgtaattataacctgggcctgcctttgttctcatgaagccaggggcctctccatatcctatacttgctcttacgctaataacaaaccaaatgctgcaaaataaaagtaataatgacccaaactaatttaagtcttttgtttaagggagtaaatgagaggaaacattttagcttctttaattcaagggagtgctataatttccagggccttcttaatatatttcacttaccctaaggcattgtgncattaggcaatttttaaaggggnaaccaccagggttaactttctacngggggnccatnggcagtt

SEQ ID NO: 2933 - DNA, 377 bp, Homo sapiens
  Genbank Accession No. R64534
  unsure (1)..(377): n = a or c or g or t
gtcaaaatgatgtatcaatggttcttttttagaacaagttttcaaagcataaaaagaggttgagagaaataacatatttattgattcacataagtatgtttttcttcattaatcgtctggagaaacccacttgtcattaatttgttttgggctaggttttcaaacttaccaaattgctttaaaaaagcaatttggaaggtaatttgataggctttccaacttaaccaaattttttattgtaattcttggatagtatttttgtctttttcaattcatttgtctttttcagtatagtttttgttaaggcaaatgtcttcccttgaatatccaaatattgctaataaacggtggaaggatgctttgggaaattnaaaatt

SEQ ID NO: 2934 - DNA, 441 bp, Homo sapiens
  Genbank Accession No. R65593
  unsure (1)..(441): n = a or c or g or t
actttacntttagtttaattataagcagaacactatcttccactagtgaatcaaatatggcaatggaaacatttttttcatgcttaattttggtcacagagaaatcatgcatttgctaccacaaaacctttctatcacctgctaatgagattggaaatttgttctagggagtccacggcctttgcggggaaacatgttgtattccggaagtgagctatccagttccatgggtcttctcaagcggagggaaagatcgtgggtgacatgtaggtgtataagtagggtagggtactgctggatgggctatcaggtgatccccaaggaaaaagagntccctttggtttatcacctttttttgcccaatgcccaacggtggcacagnctcagggggatcttatttntggggaaaggtgacccttgtttaggagggggggttaaggg

SEQ ID NO: 2935 - DNA, 322 bp, Homo sapiens
  Genbank Accession No. R66002
  unsure (1)..(322): n = a or c or g or t
ntntctgtttaagtcatttatttcaatacaggcattgttttaaatttgcaccttgtctttaacacatttcataaccagagaacaggtctgagaacaagtacataaaaggattatttgacaaagttttaacaaaagtgcttacagcttatttgtttcagatatacagaactgccagtcacaaagagccactaagtgnaaatacagccacaaacttgcctggggaagtaaaatattttacatatttacactgtacatttaaatggggatattctgaaggcattattattatcaataaactctaaggcaggaggttctcttaaac

SEQ ID NO: 2936 - DNA, 264 bp, Homo sapiens
  Genbank Accession No. R66469
  unsure (1)..(264): n = a or c or g or t
tttttttttttcagcaagtccagagcagttttaatgggggtggaggctgtacaaagagcaaggcccactgaagcgggggaaagccaggccgtgctgcccccggcccaggtatggggccttggcatggacgcccttcctccacctncagcaagagaaagagtaagcccttggggaggaaggaggggaaaccagctgagccccaaatcctggtctctgtccaagccangccccaggacanagggggactnatggtntcaggttggg

SEQ ID NO: 2937 - DNA, 357 bp, Homo sapiens
  Genbank Accession No. R66475
  unsure (1)..(357): n = a or c or g or t
gggagttgagaagaggaggaagaataatgggaggagacaggacctttttcaacttgacaaatagatttctgagagagcagacaccatcttatttctgttgaattgtatttagtaactcaaaaggcatataccaagctgtcagaagcagcttcatttaaaagaaataaaatttctagtcctgcctgaagtttaagctagcccatgactacacaagtgcaactgtatttcccgggtaggatgccggtaggattngggcccagtaagtttgtgccntttgggatgttgaaagggaaggagatgcggggcaacttttttgggtcatcttctttaaaggaaaagnccatttgtccngggggt

SEQ ID NO: 2938 - DNA, 394 bp, Homo sapiens
  Genbank Accession No. R67751
  unsure (1)..(394): n = a or c or g or t
gaatacttttttcatagttatttgtttaaaaagatttaaaaatcattgcactttggtcaganaaataataaatatatcttataaatntttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatggctaagtgggtatccgaggttcttaatatgaggattttaaaatcttnaaaatgtttcttattttncaggcacttacaagcatttgggtacacaggggtccaantaggggccaaattaatttt

SEQ ID NO: 2939 - DNA, 388 bp, Homo sapiens
  Genbank Accession No. R67970
  unsure (1)..(388): n = a or c or g or t
aaaantttatttgctttatttccttggttcctctaagttgtaatctcggagttaaaaacagctttagaaccccgcccccccaaaaaaaaaaaaaaacttttgagaatttttttcaaataaatgtccattgcatagaatgggtctgtgactggctgcttctacatctgcacccaacatctggcccccttcagaactctgagtggacaggatcaggatttgactcaggaggattagaatgtgaagaatccgtgtttgagggattcagttctccaactgcctcaaagggtctcaagtttgcataaggtcacctcctggggccagctgctccgggggaagggacgggcctaatatcagatttcggaagtgagggtacaagtnatcagggagg

SEQ ID NO: 2940 - DNA, 437 bp, Homo sapiens
  Genbank Accession No. R69031
  unsure (1)..(437): n = a or c or g or t
tagatatatttaaaggagaatatttaatgatataggaacaatacatattattatagattgataataaaaagcaggtcatggcccacgcctgtaatcctagcactttgggaggccaaggggcgggtgaggggggggcagatcacatgagttcaggagttcgagaccagcctgaccaacatggtgaaaccctgtttctattaaaaatacaaaaaaattagccaggtgtggtagtgggcacctgtaatcccagctacttgggaggctgaggcagcagaatcgcttgaatccagggaggcagaggttgcggtgagccaagntcgcgccattgcactccagcctggggcaacaacagtggtcacccttgagggnaaaaggcctatgtattaacctggaagtttactaccacacaggttaaggcacccccctcccacacacac

SEQ ID NO: 2941 - DNA, 350 bp, Homo sapiens
  Genbank Accession No. R69417
  unsure (1)..(350): n = a or c or g or t
ttttgtggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctaattaggagatgcttgaagaactcaacaaaatcccaatccaagtcaaactttgcacatatttatatttatattcagaaaagaaacatttcagtaatttataaataaaggggcactattttttaatgaaaanaatttg

SEQ ID NO: 2942 - DNA, 385 bp, Homo sapiens
  Genbank Accession No. R69700
  unsure (1)..(385): n = a or c or g or t
tgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggctattgatcttgaatttgccctctcctagtgctgcagtcccacttcaaagccattttctgaggaggatggtttaggtctggcaattgtccttgaaaaatcccacccatgttgtaccaccttggngagtcatatgccactcatcagcttggggaatgatgggtgccaactcccaatcttcccagggaggt

SEQ ID NO: 2943 - DNA, 457 bp, Homo sapiens
  Genbank Accession No. R70005
  unsure (1)..(457): n = a or c or g or t
gttgtncatttcttgtactttatttttctcaaatattttnacttatgctttttgtcattatccacagtgtttttttttnaaagcctgagccactttgtggttttagcctcaatataataatcatccccttactcttagactaattccttttcccctgtcactttgcctgtatactctgtaaaaatgaggaccttagaaaatcaacatttcctgtgaacttgagagactatacaagcagtgcccaaatcagtaggattaggcaggtaaaaccagttgggataggcagatatattatganctgttggacaaaggtatagttgtgtgcatgtctacaagggtcatcgtgattcgccattaggcttaagggtcatgtagggttgaccggggtgaggtagggctatccacagggttgtnttaaattgtggnagggggntgcagttttacattttcntgattt

SEQ ID NO: 2944 - DNA, 443 bp, Homo sapiens
  Genbank Accession No. R70253
  unsure (1)..(443): n = a or c or g or t
cgtctctaaaatttataagatttctctggggagggatttgacgtatccatgccccacctctttctacatttatgggattgagctctccaccagccacccatgggctgatgtctttggaatatggatctagtaccaacagagtcagaaaaagagatggggtccaatgggctacagttgggtggtggtcctgggatacacagcacagtggcctctactgggggatggcagctttccaggagaagagtcgcaagcttgcctgtgggacttntgtcttgtggagaggacagggctgcctcagcttgggngagacagacagagttttccgggtcccctttttccgccgcagcattgaagtttttggggggctacttggactcatggcatagaagacttnggcatttntcagggatcangggcacccgttcccagggaggtcttgaaag

SEQ ID NO: 2945 - DNA, 386 bp, Homo sapiens
  Genbank Accession No. R70319
  unsure (1)..(386): n = a or c or g or t
atggaaaaacaggatattgtttattttaaggtaggcattggctcagtggattcacatccaaaaagctgagcattgaacaaagactgagcaggatttttataagcaggcttacagaagcaaaacaggcagttaatcatataatgacaggtcacataatctatagcataactgatgacttggcataacttgtggctttgcatagctggtggccttgtagctgcgtggaaagaaaaaacaagaactggctaaatacagacagacatttgtccttttttttttttccttcacccttgctccagacgggggatgtctggngcctattccnttggtttcgacttctcgaagagcattatcttataattgtctttgaagtgagcttgctaggc

SEQ ID NO: 2946 - DNA, 229 bp, Homo sapiens
  Genbank Accession No. R70532
ctttttaatgtctgaaggtctatggggactgtctcctaggatctttgcatgtctgttgaaacaaggcagctggggaacagtacttgtgctactgagtccataggctcatctgttatttgcctggggagccaggggggtaaattcccgaatccagcattgctctcctgcgggctgtttccttggcaacactgtggtttagccgtctcagtcgttcctgagcattctgtag

SEQ ID NO: 2947 - DNA, 291 bp, Homo sapiens
  Genbank Accession No. R70790
  unsure (1)..(291): n = a or c or g or t
ggcgggnantntggtactataacttgttatttatcagggcagatcacacatttggatcaaaaagaaaaaccagcaagtagatcctaaaacacatttcttaacctgagtcataactgaaaacatagactttaattacattttgttgaaaattcattcaactttggtgcttgtaaaagcacttatgtcaatttttgacacaaatcataaccctcagtacacaggtattttcaaaggaaacaagtcatcttaaagtaatatttttctatatggctaattgatacatctttatag

SEQ ID NO: 2948 - DNA, 392 bp, Homo sapiens
  Genbank Accession No. R70791
tacaaaaaaatgctttatttaaaaatatgatctttttaaaaaggagacttttatacacacttactttagaaacagtcaaaaacacaacagaatcaatccagatttagaaatgatgatttgtaacatacaatattggtatgctgaacaagacagtttaaatgtatgattctttttgtcccttcacatttcaataattcacatttgttaaaactagtggttggggactaaagaaaaggtcatatctgaatcctttccccttcaggaaatctgtcacccttctggggcagttacaggaaatgggcaggcagctagggcaatgtttgtatttctttgggggtgcctctggtggtccaaaaaatatatctccgcttttattctttttctatggaaat

SEQ ID NO: 2949 - DNA, 281 bp, Homo sapiens
  Genbank Accession No. R70801
  unsure (1)..(281): n = a or c or g or t
caaggttcnaanggtttattagggagtcgggagggagaaaacccagggagtcccccaggccatccacattgctccccggcatgtgacgatccagcctgggctttctctgggtcctttctggacagaggctggccaagcaggcagcagcctcaaggggagtgggtaggagctgggggccttctggcagccctactcagaggatgatctggttggtgaagcttcggctcagctccttgtgtggcagaacantcgagttcaggatgagcacctcggcagggatc

SEQ ID NO: 2950 - DNA, 348 bp, Homo sapiens
  Genbank Accession No. R71082
ttgcataacaagtttatttttttaaaaggcatatagacaataaacaaagtaaataatcagatcttaacttctgtcctagacttgttccgttaagttctagtctgtgagcacttgtagttcaataatcgtcatcttcatcagagtccattacttttcttctgttgaatttcactgttgttgtcttttctgtttgttggcttacttttttaaggatttctattaaaccttgttctgataccttctcacttaggttgtccatatcttgccatctgtataagggtaattctctactgctttaggttttttcagggctttacaaggtgctaaggttacttaacctggggcccg

SEQ ID NO: 2951 - DNA, 284 bp, Homo sapiens
  Genbank Accession No. R71395
  unsure (1)..(284): n = a or c or g or t
tggaaaaaannacaactttattttcagtcatttctatttccttggttatgaacaaaggtagcaaagtgcagttgtatcagcagtgccaatagaaattacagagtttttcatatccctttacagtttgccacaggtatcttaaaatattgtttacactcatctctcttcagtttaccattgtttaataggcctaccctcgatctttttattcaatatgttaataaagaaacctatacacatagtatcacgttatacattttaaaantnttttgacaactgtatat

SEQ ID NO: 2952 - DNA, 551 bp, Homo sapiens
  Genbank Accession No. R71459
  unsure (1)..(551): n = a or c or g or t
gttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccntgttgtttgctttggnctgtgttcaatccngagggccttaaattgtccattattttggggaggaaaacccgtatttttgttaggttacatattatggaaatttcacttcagggggaactgctgggctnccgtggcttggtttcntaggtacttttccgtgccgg

SEQ ID NO: 2953 - DNA, 416 bp, Homo sapiens
  Genbank Accession No. R71491
cattctcagtttacatttattgagtgctcactgtgtgccaggaagtaagccaggtgctagaaacggcaaaggagcagggaagaggcgggtcagccgctgggttgaccctggttaatacagggtacggattaacccttcaggctcccttccgagggcctgggcggggtcttggggccgctcctgcccagggtgttctttccagcaatggaaagggattcagcgaggtaagacgcttcccctctcctccattcagagagcggcacacaagaaatctacacagtcttcccaacatgtacacaccctgacatgcccggatgcatctcacacttaggataaacacacacggacacagtcagaggcacggtcccgcagctgtattgagggtgcggtttacaggtgctgcctacgtgaccgtg

SEQ ID NO: 2954 - DNA, 368 bp, Homo sapiens
  Genbank Accession No. R72087
  unsure (1)..(368): n = a or c or g or t
caagggctggaattnaaattattgtcacagagcacaggagagaccgcttgggtctcaatgaaggtttgcttttcctcttctccaggggaagctactgcaagaaggcccaccagccaggctaggtcaaatggggttggggccacaacatgatagttaaacccataaacacagacttgattcgntcccagcttcacgacttcttagctgtgtgaccttaggtaagtctgttaacctctctcagccttggctttgtggagtggagtgaagagcagggcctgcttcactggggtnttatcaggatggagggggacaaggcctntgaaagtntttagcacagcgcctgggcagatcgtgaccagtcacggagt

SEQ ID NO: 2955 - DNA, 355 bp, Homo sapiens
  Genbank Accession No. R72886
  unsure (1)..(355): n = a or c or g or t
aagaganntnattttattgatatttaaatatattaaatatttcactgaaatacanggntcaccanccncccccacccccacagtggntacattataaaaccaaagcccangggctcccacctcctgactcctctaccaactgggtgaggaaagggacaatggtagcccaggggaagggcatggctggcactgtggtacggggatccagggtntggacangccctcccacctgggnaagaagcagagacaagccacccaaggctgaggtnttcccactctgatctacttataccctcacccctaccccatgggcaccaagtaggtctcttcctatcccttcctatccggggatatg

SEQ ID NO: 2956 - DNA, 439 bp, Homo sapiens
  Genbank Accession No. R73468
  unsure (1)..(439): n = a or c or g or t
ttttattgcttggtatnanttattgacaagttcaaatttaatgacatgttacagtttcatttgaacagtgtattactgtattaaagtatagcatcatagctaaaagaataggctctagattcagaccggctgaatttgaatcctagatctgccacttacatgaacctggccaagtaatttaatctccctaggcctcgattattcccatctgtcaaaaagaaatattaaatggtacttatatcatagtattgtaatggagattgagctaaggcatcaaaggtgcttaaaacaaggaatgccacataattcttcaggaaatatatgtaattgttattatttatcaccagtttctagtgcccaatactaggaatgtgtctggggnttcaaagataggtgcgaggganctatgtaaagtgtatgcntgccatacaagtntgtc

SEQ ID NO: 2957 - DNA, 448 bp, Homo sapiens
  Genbank Accession No. R73485
  unsure (1)..(448): n = a or c or g or t
ggcatggtcctangntattttcagacattctcgcttcacagaaagaaacagggtgaggggctcaagagagaggctgcccaagggagaagcacgggaacgctgaactggccgaggggcttntcctcatcctcaggggtagggggaagcccccatctgccagtctggctggaagggaatagatatagagcagaggccctgagtggaaggtgacanttaaccaaacagccaaggccaaggagaggaggggccctaaggcttagagaggccctnaggaccaaccttgctctgccatctgaccttgcccttntaggcctcctntgaactcccaaaatntgacctatgccatcaccgaggccgcaggaacaagaggtgggtntccatgacattggtacctttcatccctnttttcagcaggttttccccaccctgggngcagcagaagaaggtt

SEQ ID NO: 2958 - DNA, 469 bp, Homo sapiens
  Genbank Accession No. R73565
  unsure (1)..(469): n = a or c or g or t
tcacgttttaanattttacaaatgcctcttacccatctggccaggnaccaactctgaagggggtgacctcaacccagcccttgtttctgtgaggtcctgcttttgcagaatggcctgcccctgggactggagcagacttgggtgagctctaggtggagggtggtgggaggggcatagaaataaaccttcctctccatcagaaggaacctgtgatcccagcttttccttcagtcaccaccacctcgtgacactagaaagcctaccgtcacagatttccagcttactcaaaccccacaggttggggtcaaatgcatgttaacctaatttgggggaaaaaagactcaatnttgaaagcctgaggcaaagtaaagggttacacaggacagtgtcaagtatatggccatacttcataccngggcttttccctaaggcaagaactattagttttcctttttaaagtgttagcttt

SEQ ID NO: 2959 - DNA, 290 bp, Homo sapiens
  Genbank Accession No. R73569
  unsure (1)..(290): n = a or c or g or t
ntttcatcataattanagtntttattattatttgctatcacagagtagtgtacaactaacagaacaattatattgggtaagctgcacgaaaaacaattgaagagggaaaaataatatctccntatatatgtaattgatttgtactatgcactaataaagcctgccttaaatttctgttctagtttaaaccccgaaacagtaccaggcaaggttagtggctattgaaaatatcattaaggacagggttatctaaagacacactggatactacattanttttgcaaaantaa

SEQ ID NO: 2960 - DNA, 314 bp, Homo sapiens
  Genbank Accession No. R73816
  unsure (1)..(314): n = a or c or g or t
acctgcaaatcaaggtaatcgaaccaagtgcctacatcagacatgataggcaaagaccagatctgaggggtcagaaaacactgacaacaatgatcagagctaccactttaaagtaggaaagaaggtagacaagcaggatgccaatcaaagttcctgtacagactttcctgaacantcgaaacgtatctagctgacggcagcttgtcttgtttccttttgcaaaatggttctttccttgtgtcattccattttgatgtatgtgagcaaagnttgcttgtatgaagntcagacaccttttgtgttaacactaccaa

SEQ ID NO: 2961 - DNA, 385 bp, Homo sapiens
  Genbank Accession No. R76363
  unsure (1)..(385): n = a or c or g or t
cttatctcaggaaaggaaaatatgcatggttggtgagaatctaataacattaaaatgctggggcaagatgcagtacaaagttgaagagactttattctcaataagttgatttactgatgatatgtcatatgatgcaaaaaaggttttgtgtcattaactgaaaagtagcagcttctctatccagggatgatgagtcaacaggtttcactaatatttgtcatgctgtagcatttgtaagatttgtaaatgatgaaattcaaagaaaactttttctattgctaggggcctgccagaacaaaggccaatatataatgttgtgacatcatatctgattacccngaggtctgggtntctacantccgggggcccccttccggtggttttc

SEQ ID NO: 2962 - DNA, 398 bp, Homo sapiens
  Genbank Accession No. R76782
ctgtgcagtctttatttatgctgactcagtgacttcaacaggcttaatcatgtggtcaggtttgttgccagctgcataatgctcccacatctgtagatagagccgctctagttccattgtgtattgtttggtgttgaacagagggctagatattctttgcttccagactttgccacgaaatttcttcaggtattctagatcagttcccagcttcacagctatgtcttcatattcttgtctgtttttagcaataagctcaagacaacctaaggcaagtgagctggggatgctgcaactcgaggaaggcaaggagtctctcctgggcataggtcaccatgggggggtccctgcccaggagggacatccatccctgtgggtgtgccccttacagagtggga

SEQ ID NO: 2963 - DNA, 389 bp, Homo sapiens
  Genbank Accession No. R77451
  unsure (1)..(389): n = a or c or g or t
aattaatatacataatgtatagtagttcatataatttattaatggcatttnctataggacactgtaattaattcagtgacatcaatattgacctcatacagacaaaagatgaaagctgggttttctcgtgtaccaagtacaaaacatgtgctaaaaagttaacatacacagttgtaagagnncaacgtcgggntgactcangtttntagtagttgcttcacacggttttccaagacttggntgccacccagtgttgccgtgtttgtgcaaatgccagctctgggncggcctgactacctccttttgccagccccacttttgcctgttttactgctgccgctgctaggatttgccagatgnttttgaagngaagagtcttgtcatgnact

SEQ ID NO: 2964 - DNA, 401 bp, Homo sapiens
  Genbank Accession No. R77539
  unsure (1)..(401): n = a or c or g or t
taagggtggactagtaataaaatataatattcttgctgcttatgcantggacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctggggataaaaactatgtaggcagggcagtgtgttttccttccatgtctctctggcactacctgncagtgtgttcctctggagggctggcaagtctgttcctattctgaatttcccaggcaggaaggcactaaggaaggttcccaacctnt

SEQ ID NO: 2965 - DNA, 435 bp, Homo sapiens
  Genbank Accession No. R77628
  unsure (1)..(435): n = a or c or g or t
agtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttccnggngttaatttgttttacaggaattttgttttttaaaaaaataggatcattctgaactttggaatggcccccttatatattttctgaaaatgaaaacagttacatgaaaaaaatttccaatgaaggatgtcagcattttatggaaaaaccagaagttattaggatgaaagcagcgagtgaatccttttaaaaccagactttgatccacgnacacacattaagncttttntctccgaaacccggagtaantcca

SEQ ID NO: 2966 - DNA, 429 bp, Homo sapiens
  Genbank Accession No. R77631
  unsure (1)..(429): n = a or c or g or t
tatttttgtagagatgggggagacaaacggtaaacagatgtttcctttccgatagtgacaggtgctggggggaaactagactggctggcggggtgggggcagccctgcaggagctgaatgaggagaggctgcagagggaggggctggtacctgaggggctgtttgtgagaattagctggttcggtggagaagcagaggaacacctgaggggctccaggagaagcaggtagggagaagaggttttctgaggggtngaggcaggggtcatacatgctgggccttcaagggccatgatatggttatcattactatgtaataaaccaccccaaatgcagtggcttaaacaactacttatttctcatgattatatgctgggctgccngggtncacaactgtgccggtnttttaacaaccttcttttcagangtt

SEQ ID NO: 2967 - DNA, 325 bp, Homo sapiens
  Genbank Accession No. R78713
  unsure (1)..(325): n = a or c or g or t
ccccatgttagccaggctggtcacgaactcctgacctcaagtgatccgcctgcctcagcctcccaaagtggcagaattacaggcatgagccgcttgtgcccggctgagattttacatttttttaatggctggaaacataattcaaaacaataatatttcacgacacatgaccatcacatgaaattcaaatttcagtgtccataataangttgtattgangcacagtgacactcctttgtttacatactagctacagacactttcatactcacagcaaagcttactagttnttangagaccatatgtcccacaangcatttacaaa

SEQ ID NO: 2968 - DNA, 433 bp, Homo sapiens
  Genbank Accession No. R79246
  unsure (1)..(433): n = a or c or g or t
ctgggacaattaaantttatttttcatatatatatatatnnccatatatatatatacatncatatatangggaaacaatttgcaaatttacacacctgacaaaaccatatatacacacatatgtatgcatacacacagacagacacacacacccgaggctgctngccaggcccgttttccanccctaagtaccattctctcatttgggcccttctagggttggggccctgagcttggtttgtagaagtttggtgctaatataaccatagctttaatccccatgaaggacagtgtagacctcatctttgtatgctccccgctgcctttcagttttacgtgatccatcaagagggctatggggagccaagtgaacacggggggnttgaggctaattcacctggaactcgaaaacagcgcccagttttcctnaccg

SEQ ID NO: 2969 - DNA, 430 bp, Homo sapiens
  Genbank Accession No. R79580
  unsure (1)..(430): n = a or c or g or t
ctcaantttacagtttattacagtgaaaggataaagattaaaatcagcaatgaagaaaggcacataaggtaaggtccaagagaacttccaattatcctctcctggcagagtcttcaggataatgcttaattctcccagcaatgatgtgtggctacaatgatgtgtgcacagagtattaccaaccagagtagctcacccatgcctagggtgtccaggggcttactaggggnttgatcacattgggcatgcttcactgcccacatgggctaacttaggtctcctcaggcttgaccttggcaagggtcaagctggaattactgcatgggccccaaggccccacagggtaaacaaaaacactcttnttcaggggcaaggatatttcttaatgggcttaggagggtttttcttcccgggggngcccggggnaggg

SEQ ID NO: 2970 - DNA, 227 bp, Homo sapiens
  Genbank Accession No. R79750
ctggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaaaaaaaaaaaaaaaaaaaaaaaaaaaaaaaa

SEQ ID NO: 2971 - DNA, 359 bp, Homo sapiens
  Genbank Accession No. R80048
  unsure (1)..(359): n = a or c or g or t
tatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatggaaatcttgggtacaaattcaggtgctcttatttaaaaattttaaataaggggnttacattttccaaaatggcggtatccaaatgtggatcntggtgtt

SEQ ID NO: 2972 - DNA, 406 bp, Homo sapiens
  Genbank Accession No. R80573
  unsure (1)..(406): n = a or c or g or t
caacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctggagtngaatactggatagtgggactaggaaaagcatagtccaaggaaaagtggacccaccttgtttanttggaccaggcagttntagctggaggaggt

SEQ ID NO: 2973 - DNA, 382 bp, Homo sapiens
  Genbank Accession No. R82074
  unsure (1)..(382): n = a or c or g or t
tttttntangaaatgacaagtaccgtttattgtcgttacacaaatgaacccagcctctggcttgggcaccgtcccacggaccagcagatgagcatggtcagccgacccctttccccacccccgagtcatgtgcagtcatacantccagggagaaagtcgcagtntcgantaccggacacaggttcccttggnttggtggngcatctntgatccacagantggcccacctntcggagtggccaacggagtcgntgaaacgttgtcaaataagncaagtaagtgcaggagccctggggntggggggcctntggcttntgncagccgggtggggaggagggatntccaaggtttctgcggggtagggcctcggcttccanacctc

SEQ ID NO: 2974 - DNA, 466 bp, Homo sapiens
  Genbank Accession No. R82229
  unsure (1)..(466): n = a or c or g or t
gaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctgggactctgctagtgtcttcttgaggacactgatggacactggatttaatgataacagacctttggcagggacctggatggagttgaccctttttgggagctgggccagggtcctctggcaggcagggcaaggaccaattcantcattggaacctggcntcatgggnaccagagttgaacan

SEQ ID NO: 2975 - DNA, 429 bp, Homo sapiens
  Genbank Accession No. R82837
  unsure (1)..(429): n = a or c or g or t
agttnatnaataaactgtattattacttgcagtcatcgacatctaggcaagatgtacaatgtgatacttgacaaaattcagtctgatcatccaataactcacaaatgcaagctcacaaaacattaatgaattatgcaattgcaaagtgctctaatgcaacattaaccacatgcaatcaacaatttgggnacagtatccaaacagacattatacgttaaacgtttagttttcaaggaaagaaagcagcttgaagtttactgggtgcaaattaattttggtcttcagatttgggngcccccaaacaaaagggttagggnttggattatggaattctgatgggtgggtgggcccgcnggttatggggggggnagccggccggaaacttttggggggngtttcttccaaaattaggnccctttncccggnccg

SEQ ID NO: 2976 - DNA, 427 bp, Homo sapiens
  Genbank Accession No. R85266
  unsure (1)..(427): n = a or c or g or t
anttangatttaatatatttattgaaatacaaagagtcaatataaagaaaaatagaggtcaccatacttggccacagttagaccgctcataggcccatggctgctgcaaccatgggcaggacacagagggagtccagcctctactgataaatctgggcaggttcaccttcgcaggccaagccaggggccatccctgggtntgcgaaacctgggggttttccagggaagccggctgctccagagctagctntcaagtntttagccccacaggctgggtgcccagaggcacttccacaggagcagcctcgggnttcacccacacccaaggagtttccnaggcaggaggcaagcaagggtnaagggagggttcagggttccacaacagcagttngcaggggtccngcccttagggcttcagagncttttt

SEQ ID NO: 2977 - DNA, 127 bp, Homo sapiens
  Genbank Accession No. R87373
tcagattattcccttaggatagtctctcagtgccaagttgtcaaaaacatctctattttgcttatcttcctgctctcttgctgccttagggggtagtaaactgaaacataaagtaaacatgcataca

SEQ ID NO: 2978 - DNA, 361 bp, Homo sapiens
  Genbank Accession No. R87989
  unsure (1)..(361): n = a or c or g or t
tgcantaantttcagggtttattgttgaaggagaagatgaaggaggtggtgaagtgctaggaaaataaatnctagatgagaggcagtacatgtccctcagccagggcaaggcacccctctgggtgatttccatagggagcaagcaaatgcaatttgcctcattcccaggtgagttggggtcctccccagggttgcagatttacttcctcttcctgggaacacccgccgacctggggctcctgggtgcctaacagagccaggnttttcctttggcaaacctgtaggtttgcggaggggccatgacccatgacacagtcttctgtctgtgtgctcctgggctgtggctgctacctgggaggcg

SEQ ID NO: 2979 - DNA, 355 bp, Homo sapiens
  Genbank Accession No. R89811
  unsure (1)..(355): n = a or c or g or t
tcagcaaggcagggaatggtgggaaccagggntgtcccgctggagggtcaggagggagccacaagccgcctgggaggccgtatccggtcgttgatccagtccacatagttggccacgcgggtntagacccccggcttgtggagccgcccgcagccgtcaccccagctgatgatgccgtagaggtaagccacgccgttcttctcgcaggccaggggccccctgagtccccctggcaggcgtcggacttgcagtcgaagtagccggcacagagcatnttggggctgatgttcggcgccgtagacctcagggctnctgcacttgtgggtcggcgaccaggggggaccagggntttccc

SEQ ID NO: 2980 - DNA, 318 bp, Homo sapiens
  Genbank Accession No. R91060
  unsure (1)..(318): n = a or c or g or t
ttgtcttagaaatctataggaatttttaatgtatatntncnanaccagtncantctttacatgttgtagtaggtagcctctaaactggctcccaatgancctcaccctcctggggggtgccttgtacaaactccccttgaatgtaagctggagttattgccttgcttctaacaaaaagaatatgggcagaagtgatggggtgccacttccaagactaaaatactgtgggttnccatcttggggtgtttnctctnactcccttctaggaaaggccagctctgaggggccggctaacatccncagggggggggccccaag

SEQ ID NO: 2981 - DNA, 386 bp, Homo sapiens
  Genbank Accession No. R91503
  unsure (1)..(386): n = a or c or g or t
acatttattttcttaacctgggtagtaggttcatgggtgttcacttatccttttttaaaacgtacattttatacacacttttgtatgtattctgtattttataaaaaataaaattaaataagaaattattcttatagtccttttctaacccatggggccttctgctagaattttgtgctgttcacattctcaatgccagcttccttagccataaagtaaaagggtccaggggatttgtaggcagttcttcagggctgccgcactctataatcttcccgttgtctagggnccattaccttgtcactgtccatgatgggngtgcagcctgtggggggnatgggngatcactgtgncagtggggcgaactcgttttgggatgggncgtc

SEQ ID NO: 2982 - DNA, 338 bp, Homo sapiens
  Genbank Accession No. R91753
tagtttggccactccctagattcttggtttaccagcttataaagagtacacctaagaggcagtataatatacgcactaaaaaccatttccccctttatcatctttggctagaagcctcatgaaaggaaactgaggacggcagaggcaggcaggctccgtgcgcttctgcctcacacgtcactgaccggaaggctcgcatcgtccaagtctactaggtcacaatctttttcctgagggccatttttactttgaggtcttaacagagcttgttcagtcactttggaagctgggttctcttgggagagacagtctgggaccttgaagttccctgggcttga

SEQ ID NO: 2983 - DNA, 409 bp, Homo sapiens
  Genbank Accession No. R91819
  unsure (1)..(409): n = a or c or g or t
caataacaacgtaccgtacaaaacctgcctcccagctcgtggggcaggcagtntggtggccaagggagcgtagaaaaccagggctcttgtcccaaaagaggagaggaaagagggttttgcagtcaaggaaaaacaatcaaaacccaacatgatcgaagagaagccctgaatctgcatcagagggaggggccgtgggcagttgtcgcaacttggccactgcggcggcaccagtacggggagctgtgattcctagggagggnttggggccagctcacaagtttatttatttatttttttgagacggagggagtctccctctgttacccgggttggagtgcagtnggcacgaatcttctggcttcacttgcaacctccattntcctggggggttcaagagatttntcacggc

SEQ ID NO: 2984 - DNA, 359 bp, Homo sapiens
  Genbank Accession No. R92449
  unsure (1)..(359): n = a or c or g or t
acaacaaccctatgaggtaggtactattattcccattttaaagatgtgaaaattctatacagagaggttaagtaacttgcatcaagtcagagagttaataaatgagggagctgattaaaattcaggcgcctgggtacccaagttcctgttcttaaccactacactctaggcagcctctaagtttaggccctgcaaccagagttcctccaggggaagggaacgcttcagggtcatgggagaagttcaagggggaaaatatccaaatgggctctgtctccaaatggggggagatccctaagggggccagaggaagggtnagggccaaggggggaggccttccacttacagnggaggccagg

SEQ ID NO: 2985 - DNA, 260 bp, Homo sapiens
  Genbank Accession No. R92458
  unsure (1)..(260): n = a or c or g or t
tttgattgcttgcagaataaagcctatccttgaaagccctgcatcatgggcagtgagcncagtggnatctggnggacagggcactggccactccagtcaccatcttctgccaggnggcctgcacctcaggggtgaattctttgccgaaatggattgccaaaacggtcaccagcacatttcccaggggcttgaagttctcagggatccacatgcagcttgtcacagtgcagttcactcagctggggcaaaaggngcccctt

SEQ ID NO: 2986 - DNA, 377 bp, Homo sapiens
  Genbank Accession No. R92475
  unsure (1)..(377): n = a or c or g or t
gatttaaaatacatctttcatacattgtttaaaaggaaaaaggaatcatgtcaaaatgtttcaggaaatgatttaagttagatataaagancatagttctgattttgaagtgttagtggaactcaaacagaaatgattagngctctcttaagancatgacatgattcttaaagtgggctatttcagagcctagaaataacactgtattactgactaatgtctacagagtactgcaaaagatgctggaataggaaaaggcagggtgggtgtgaaanttttaatttttaaataggcaaagcccctgtctgggggtattgtcaggtaactttcnggaaatccnaggaggaaaatgatggttaggggnccacnccaggggg

SEQ ID NO: 2987 - DNA, 357 bp, Homo sapiens
  Genbank Accession No. R92737
  unsure (1)..(357): n = a or c or g or t
ttaatataaaagtaaaagagtacattgttgagtagaggattaaaggagtgacgaccctttctaaagtggggtctcccatcccggatccctaagactgtaacatctgctacatacattaaaancaaaacaaaacaaaagcaaacatgaaacttatgacctgacttcactccacccttcatgcctgcattatgacagaaacacgtcccactgctcctacttatgtatgtacatccagaggctccaaacctaaggctgtgggccccctcctcccaggccccacacacacacacccctggcacacacatggcacacacatggcacacacatggcacacacacacatacctggctggcccat

SEQ ID NO: 2988 - DNA, 401 bp, Homo sapiens
  Genbank Accession No. R92768
  unsure (1)..(401): n = a or c or g or t
acagtaccatagtattccactgtctagtatactataagtganctatataccaataatgaatacttaaggttgtttcaaatcttttattattagaaaagtgctgccagaaacatccttgccatgcttctgtatgtactggtgctagtgtttctatcagataaatttttagacatgaagtgaattactaggcataggnaatataatttacacttttgatagatactgagtttttgctcatttgctacatgaagcagaggcagagtattctgtgtggggtttgggacaggaacactgacccctgaagtcgagccggggggtctaacataggtgggtcatttgtccagcctgttttatgggaagggaactgggactctgagctttggggggaatttcccgcaagg

SEQ ID NO: 2989 - DNA, 328 bp, Homo sapiens
  Genbank Accession No. R92994
  unsure (1)..(328): n = a or c or g or t
tgagccaaaatatatatacttaattttagttatgccagaagtaagtataatttctcagtccaaggatgttaggaagcaacttacagagcatgcttcaaataganttctcttggcctttgaaggtaactattttcaaacttaatagtagagtcaagcaagantggacaattagagtttncaaanttgaaaantattatgtattttatataatcattacctatggtttacagattttatttttatgatacatatctctaaggtaggtgggtacactgaggacataggcaantatgccaataaatacttatttaagctggaagtganctaa

SEQ ID NO: 2990 - DNA, 334 bp, Homo sapiens
  Genbank Accession No. R93507
  unsure (1)..(334): n = a or c or g or t
attttncatgcatttgttactcaagaaaataaacatacaaccacttaaaatacagcattcacgttgtcactggtncgtggtatcaggtaaggaaaaaatgatgctcatgnccctagaatttnccatgtacatgtcagtatcctaatgcctacagacttcctattaattttgttatcagcatctcccacctaaaaacatatactacattatgttctgggtccctgaaatttcattactacatacagtgttaatttttacttttcctcaagtttaatgtagacatacaagaaancatcaaggcaatgtttattgtgcaattccaatccattatttg

SEQ ID NO: 2991 - DNA, 431 bp, Homo sapiens
  Genbank Accession No. R93714
  unsure (1)..(431): n = a or c or g or t
aagtaaganggnnnnaanacccactggctagaagccctgggtgactttgaagagagaatactgcttggatgtgttctcattgttgtatttcgcaagagactcggtggcagcctccagcacttggtgattggaagagtcagtgggtatggagcttgggcagtcagggcacgtcatgtaaatctttttttttgaaattgcccgtctgtattcctggggcgtcgttcactcggttgagtctcagcacatagccatcctttctgtctttgttaatatcccgcaggcaaaagcctgcaactgccagcacatcggagtcattgcagccccgggagagcagagccgaggggttgaggggccagctnggggttggagacattgcttccgnagcacaggacttgggatgcagagtnccagggggaaggngcagacccttt

SEQ ID NO: 2992 - DNA, 489 bp, Homo sapiens
  Genbank Accession No. R93776
gctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataaggcataactaaacttgttcaatttaggagtttatttttctatgggtactatttaaatgtctcaaattggaaattttagcagtctgggatttcaagcttttgaggggaaaggagggttcacttttgtatactaaag

SEQ ID NO: 2993 - DNA, 223 bp, Homo sapiens
  Genbank Accession No. R93908
  unsure (1)..(223): n = a or c or g or t
catatatnnaatantaaaaatcctgggaggcattgcactgtaatagtaagtctgcccatccaggntcatgcatgtcttttctttcattcaagtcttattttatatctttcagtaaattttcatatagatcttgtgaatcgaattatttttacatttcaaattcaactaacaattattaataganaatgaaaacattgatttttttcaatatttattttgtgtc

SEQ ID NO: 2994 - DNA, 500 bp, Homo sapiens
  Genbank Accession No. R94662
  unsure (1)..(500): n = a or c or g or t
aatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggaggnacaagccacctaccggggggacatctacttctgcacgggttatgaccctcccatgaagccctacggacggcgcaatgagatctggctgttgaagacatgagtgacccactgaaccaagaacttactgggaagtgtgcctctgtgtctccttccttcgggggtaaggaggggacagtgcttcccaagttccagttncaagtccaatttaaccaatttcctttcaaagtnagttaattgccattttntgaaaaaaggctgtttcctattattagtttttttntcacagtgggnatt

SEQ ID NO: 2995 - DNA, 377 bp, Homo sapiens
  Genbank Accession No. R94674
  unsure (1)..(377): n = a or c or g or t
aaattactaaaatgtttctcatataacagtaatgattattctaagcaactgcatgagccttggaagattcttcatctctaacacatgttcctctttcagaaaatatcaaaactctcatttctctgttgtccaccttcctcctgaggggactcaggccacacagggggtctcttctgactgagaatcccnaatactgangatgtgggcatcaccagtgatatgggtttgggctatgtccccactgaaattgcaacttgaatttatcttctgggaattcccacatgttgtgggaggggacccggggggagggtcatcgaatcagggggggccagtctttccngtggctattctcatgataggtaaggtctcatgaggat

SEQ ID NO: 2996 - DNA, 179 bp, Homo sapiens
  Genbank Accession No. R95966
  unsure (1)..(179): n = a or c or g or t
acggggagagtgaggaggaaagaggaaaggaaggccagggtgggaggaaggancagctaaanctgagggaagaagaaggaaaggagagggactattncatagcagatgcaaatgaagggacttggggctagtcaggaagaaagggaaagggaaggaaggcaagagagaggggtgaaggg

SEQ ID NO: 2997 - DNA, 389 bp, Homo sapiens
  Genbank Accession No. R96417
  unsure (1)..(389): n = a or c or g or t
tgtactgtaggatgtttagctgcacccctgaccgctatgcataaatgccggtactgtcccccgaagttgtgacaaccaatgtctccagacattgccacatataacctgggaaaaaaaattgccccaagttctgagccactgggtagaactaagggtagtttagggacaatgttaatgaaagcctctccaaagtcccatagtctttttaataattaattctgcagaatttgctctttaaaaacatatttttaaaggcaagaccagcctattcataaaaattgcagttgtttccacataaganctttggatatttaaagaaaaatgtaatttgaaatggaaangcccttataaatccctttatactcattcagttctttattaacagtnaa

SEQ ID NO: 2998 - DNA, 354 bp, Homo sapiens
  Genbank Accession No. R96527
  unsure (1)..(354): n = a or c or g or t
acanaantgtgggataatctattttaatgaaactcattatatatatattnncaaaaagantaaaggaaaaagacaaaaacaaaantagatnttacagcttaataaaaagtacaactgagcactgtgggctggaggtgggatacccacccgcagcacgcccaccctaatgtgccatctgagggcctggggaaaggacagtgggaaggagacagtaggctcagcccagagntgcccctgtcctcagggnttcantgtagtttgaccctgacattaaaccttttatgtccttcccagtcaggaaggtggctgggtacaggggtgggggtgaggagcagagagaggtacagggcagga

SEQ ID NO: 2999 - DNA, 252 bp, Homo sapiens
  Genbank Accession No. R96822
  unsure (1)..(252): n = a or c or g or t
nnnccttattttccttcaaaaaatagtttattctgcacatttcctagtaggctctctgcccaccgttccagggtagcagctactcataacttgtctttctctccaaaaccaagagggccttcccaacagaaaaaccttcagttcccaaagcagcatcgattcttcccctcaccccagcaaacctcggggtgggaataatgaatcattcaccttctcccacccctcactgccccgccccaccttcatttgccg

SEQ ID NO: 3000 - DNA, 334 bp, Homo sapiens
  Genbank Accession No. R96924
  unsure (1)..(334): n = a or c or g or t
agtaaactttattngggagatggggtgaatccatcactggttactggaaccctgagtctgcattttctcctcaggaaggcggtctgaaatggagtgggctgtgtttggcaagggttgtagtggtttggaatctctcacctgcttggctcccgagctgggcctcaggctgntctccccagagtaaatgcccgggatcattgaggaagcgttggctgcgctgggcatgttagggcaggtctgtacggtccagcgctgtcccctgcagcgtctctgggcgctggggtgcaggtnaggcccnggacgaggagggaagagcagcctcgacagagagtcc

SEQ ID NO: 3001 - DNA, 396 bp, Homo sapiens
  Genbank Accession No. R97176
  unsure (1)..(396): n = a or c or g or t
ntanacccatactttttatttgttaatttcatcacccccctcttcttctgatgtggtccccaccacctctgacatgcacgcattggctagggcctctcacactgaggctccacgcgaagggaagatgcaaagtccagtccctccaggagctagtgatggaagtcttgggaaaggagagtcccaagttcaagaagacagctagggtagaagggagggaggtcctcaaggggtagaggacaggagtccaaggaggtgggctcaggntgcggggtgggcgcctcagggagagcccagaaatctttccaggggcagcactntcttggaacaggggctnttgcacttnacgggtaccccgcattttttcattccccaaccttcagttgggccccccattgc

SEQ ID NO: 3002 - DNA, 392 bp, Homo sapiens
  Genbank Accession No. R97302
  unsure (1)..(392): n = a or c or g or t
ncatgtaactctctcagtcttgtcagaacacaacttctgctatggaggaaatatttccatcaggaaagggccaagttagtgtcttaacttgactgccttgaatggggactctggaccccaggaagaatgtatttaggctcctcacaaaaaagagtgatggctgggcaaaacaaatgtactgcaagacccatcttccctccagttaatacactcccagggatgggctgcagagggggagactctgagagaagctggaggcccacaaaagtccactgaccctctttctgtcccagaaatgantaaaggaccagttggtgctttccttccaaaatcctcaacaaaggtggtttgtgctccaggaaaatgtggggggttaaaaaaatcatgtcccg

SEQ ID NO: 3003 - DNA, 349 bp, Homo sapiens
  Genbank Accession No. R97419
  unsure (1)..(349): n = a or c or g or t
tttctaacatttaatctccacttagggaattggaggtcagaaatgaataaaataccatgccccagtaggctccagtctagggaagtgggcagcaggcagaaaccaagacacagaaagcaacgacacataacagatatgctatgatacaaatggtgctgcaggagctgcacagttcggaggccatttctggccagaggatgggatgcgtgaaatccaggaaggcttccaggaaggagtagctggcactgggatgggcaggaacagcaatgtctctactgatggtttcattggagaaagctggcaaagttgagaagtttggagactaaccgtgacaaantttaaacatcag

SEQ ID NO: 3004 - DNA, 454 bp, Homo sapiens
  Genbank Accession No. R97711
  unsure (1)..(454): n = a or c or g or t
gtggagacttaactctgtcatggaactccctgattatggtatttnctgaagttcacaatgttatgtattctaaagggaaaaaattaaccagccatggctttccaggnacaatctttgaggaaggaagtgagactgtttaccgtgttttctatcagaaaaggaatgttttcagctcatctgcacttggatcaatatttttatctttgggtatcatttggcattgctgtcactggagctgcaaaaaacatgggaggagccaggataacccaaaattctcatcctgcactttgcaaaagagaggacaagctggggtgtcgctctgtcatgtgtggtcccacctccagggagcttggggccagggagggaactggggaatgcctatgcccattcagcaatagggcgtcccggggggcacngggtcagaaagncatagagggagggggagggagaantt

SEQ ID NO: 3005 - DNA, 452 bp, Homo sapiens
  Genbank Accession No. R97759
  unsure (1)..(452): n = a or c or g or t
acatgactctnnncnatacatctgttgataagaaacccaagattaatttagacaggtgcattcaataagggcagggaggtctagtgcacgtcccggccggcccaggaggacaggaaaacatcactcacgaagtcatccttggccccgagccgctttgtcctgtccttctgcaggaggccctccagggaggtgtcttgcggaatttgtaatatttggtttcagctgggagaggcttgttcaggaatgttgtcgtacatttcagctgtgtttcgggctataaaaaagggcgggctggaaagaaggggggaaaattacttttaggacttaattggggaagttttcatatggggcacacatttacccagtagggaggaaaaaggatattaaacggggcaataaatatttaggggctccgatttttgagggaactcttcccccaccctncaatggct

SEQ ID NO: 3006 - DNA, 487 bp, Homo sapiens
  Genbank Accession No. R97798
  unsure (1)..(487): n = a or c or g or t
catctcagcctntttacnttcatctcagcccagcacttctgttggggctgagatggaagtctcggaaggtgctctgaggaggtgtgactctccctggctgacaggggaaggcttagcagagctttgtcttagaggagtagatgaaaaggaaagtacagagagggcattcaggccaagtcagcaacacagacaaagtcaggtaatgtgggttaagtgcatgggtgatgagtaaaggggatgtggctagatggtgtgagtgtgtgtgtgcttgcatgtgtgcctgtgtgcgtgtgtgtgcatgtgtgtgtctgtgtgtgagtgacagcaacagcaaagggcccgtcatgagtggctaagaccagatgtagggtagactttggagggggctgctaaggattttcatagggcantggggaaccatgaaccttcnctagggcagggggangagcnttccggaaccnatccccgaactttntccattgcaatt

SEQ ID NO: 3007 - DNA, 405 bp, Homo sapiens
  Genbank Accession No. R97804
  unsure (1)..(405): n = a or c or g or t
tttatgtntggggcagctttttaacccagcacagaatactatactatacggtttgtgaaagcttcactggcaatattagggaatgaagaaagttgaatttaccagaagtcacctcagagaatagtaagtataataaaaggaatatgtaacaagcccctggggacaattggtagagaaaccctgttcacccactaagaaaaaaaaagcaggctggagtaatagatgattttagaaaggggagacaaatgagcagtggcagggcttcagttaggttcccagggagcacaggcattagaactacctcccagggagactcgttccctgcccttcactagagtaggcagaactaagagtgcctgagttgggaatctctggggggtcacatgaccacatagggagggaggg

SEQ ID NO: 3008 - DNA, 489 bp, Homo sapiens
  Genbank Accession No. R98073
  unsure (1)..(489): n = a or c or g or t
ggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcantgaagggtgctgcagccccttcccttccagcccacaagtgtgtgcatattgagctcctgctgtggttaagcactgcaacagactctaccagagatgcaaagagaagcgagagagggcaccttgttctccaagaacttacttgttccaatcatgctgtgggtggcatttcctttggaagatcatngaaggaataggccaaactttgtcttttgaggggtggaatttttgaacactttttaaaataattcaggaagttcacttgagggancccaaaggttagttggaattaantttcaaggttgaatt

SEQ ID NO: 3009 - DNA, 452 bp, Homo sapiens
  Genbank Accession No. R98074
  unsure (1)..(452): n = a or c or g or t
tcacttnggatagttaaacatttatttcaataatgctaccattgctcaaaacattctttacatcttttcttngggattgccttnggagtcattgtataaatcattaaaaaaagcagactcattgctttagtttagtgttgctctatcatcctcaagtatctagcttagtcacttgaattattcactagctttgggtctcagtgacttctgattattttaaagngtcaaattcaccctcaangacaagtttggctattcttcatgatcttcaaaggantgcaccacagcatgattgggacagtaaggttctngggagaacaaggtgcctctctcggcttctctttggcatctctgggtaggagtctgttgcaggtgctttaaccacagcagggngctcaatatggcacacacttnggggcngggaggggagggggctgcggcnccccagccga

SEQ ID NO: 3010 - DNA, 261 bp, Homo sapiens
  Genbank Accession No. R98105
  unsure (1)..(261): n = a or c or g or t
agtannataccacagagaatagttgggatgaaaggcatccagcccctgcttcctttaagatggcctctaggcaggtgggtgttctgtaagcctggcaaaaattctggagccaatctctggcaaggctgagtgccaggcggggcctagggacccagggtcggtgcttaatgcctcccgcccattggaaattactgacctccaaatatatatatatatatgttttttaatttaaaggggaagtacactgcacaccttcctcca

SEQ ID NO: 3011 - DNA, 424 bp, Homo sapiens
  Genbank Accession No. R98413
  unsure (1)..(424): n = a or c or g or t
attaagatatcaacgaggtacttcttggttttattagatatgagaattatcaattcaagtcagaagtgccacaaccactgccatattagaaagattagtacccgagagcccagactgtcacccggctggaggcctctcgccgatggctcccagggaccactgacctaatcaagggcctcctccttcacacgccaccctccaccccaacccctttatgccttcttaaagtccttcagggaggggacccaccatcaagattgtcctttctgggcacctaactcttctgtctgctagaagacagcaatgagactgtccctacaacgatgatgcttatggtggccacatctcaaaggaagctgagaggggtctnagccccgtattnttcacttggggagggcagaacccaaattttagtaaatgaagg

SEQ ID NO: 3012 - DNA, 323 bp, Homo sapiens
  Genbank Accession No. R98624
  unsure (1)..(323): n = a or c or g or t
ttaattttatttttaatacagattttcagtaaggggcattttcaacctaattggntctattttcttgtatttnccattttaatttgcttcataacttaaaccaaggctcttccagtcttagttattatgtctcagttatgtgccaatgggcatgtttttaagaactgaagaggtaatttattgcaatgaactaactgacctcctccattccttctttcctttttgacatgaattttactaccccacaaatgaaaaatgatgttgcaaagttactgtggtgaagttgaaaaatatcactaaaatgattataatttaggtattaa

SEQ ID NO: 3013 - DNA, 382 bp, Homo sapiens
  Genbank Accession No. R98774
  unsure (1)..(382): n = a or c or g or t
tgggtcatgaannccnantgaaatttatgagaaagctcagaaaatattcagttttcatagtcccatgattacatactcctgttcatgagtactagtaaaaggttgattatgccagagaatttctataataagcattagcaggaacccaataccctgtcataattcagtaaggtttatatattttggcaaaatcaataaattaggcattcagcaagaggcaatgtagaggcagtcattcttgcagtgtaaagatctttttggccaggcacggtggctcatgcctgtaatcccagcactttgggagggctgaggtggaccgattacttgagctcacaagttcgagaccagcctgggacaacatggtgaaaccccatctctacaa

SEQ ID NO: 3014 - DNA, 325 bp, Homo sapiens
  Genbank Accession No. R99014
  unsure (1)..(325): n = a or c or g or t
gatgtaagttgaagganttgagagtgttttattatagcaatgtaattcagttctttgaattccttctatgttatatgtcaacatttgtgtaatggtctattagcaaaaatatttttaatcttcgggcacatgacaatttgataaagtccttcttcatttcttttaaacagtgaactagggaagcacctgactaggcaaagagatttgttctccaacaatttgaataatttactttctcaatttctggggaaggtataccaagaggagctttactaaggnttcatcaaattattgttaattgtgccggtaacacttggtacttagg

SEQ ID NO: 3015 - DNA, 474 bp, Homo sapiens
  Genbank Accession No. R99591
ttttcaaatgttcctttcattgtttcattcctttaatgtttgcagacatagattagtaataggacctagattagtaatgtttgcagacatagaccttagtaatggtctgcacatctgaccaaagtgacaggtttgaggattccaggcagcttgagaaaaggcaggaaaggccagaaccagtgtcaaagggtcagggttgagcacaggatacatggaagctcatcttccccagcaagagggaactcaacagctcacatctacaggcagcaatgggggctgcttgtccctgagagtaaggcataagcccagtgttcagactcctgaggggatgagggagtagtggctcaagcctgagccccaggaatgagtatgagggataatcagggctcagggagaacaagcagaggggcaggcggggccagggggggcagggtcaagcaacaccagggtactattcctgagcagttgacagcc

SEQ ID NO: 3016 - DNA, 287 bp, Homo sapiens
  Genbank Accession No. R99909
  unsure (1)..(287): n = a or c or g or t
atagccacatgaggctagtaactgtaaagaactgtgacaagcctgagatgtctccctatttgcaagctgacaaattagcctgctgacagatgctggcagaagacaggagcttcctggatcagagacaagggacttcattactcaaagcacagcgngcagccagcttgagtttcatacttgcgtcatttctgcttgcctctaagtcttatggggttttgtgcaaaagcatttaccattatctgcactgttttgtatgatgcacaagctttcagagagggactatatat

SEQ ID NO: 3017 - DNA, 456 bp, Homo sapiens
  Genbank Accession No. S48983
ctcctttctttgggttgcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgadgcttcctgctcctctgctctcagggaaactgggctgtgagccacacacttctccccccagacaggacacagggtcactgagctttgtgtccccaggaactggtatagggcacctagaggtgttcaataaatgtttgtcaaattgaatttgttggtggaaactgggaacattgaggcagactttctgggaagaatggtcatctgaggccatatggaagataaacagcaccatggcagatgagcctgtgactgagggggaccaaggactcccag

SEQ ID NO: 3018 - DNA, 1194 bp, Homo sapiens
  Genbank Accession No. S52028
ttcttttcctctcttcttctttcgcggttcagcatgcaggaaaaagacgcctcctcacaaggtttcctgccacacttccaacatttcgccacgcaggcgatccatgtgggccaggatccggagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaattcacagctagtattccagagctgctattagaagctgcttcctgtgaagatcaatcttcctgagtaattaatggaccaacaatgag

SEQ ID NO: 3019 - DNA, 453 bp, Homo sapiens
  Genbank Accession No. S54005
gcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggca

SEQ ID NO: 3020 - DNA, 1270 bp, Homo sapiens
  Genbank Accession No. S56151
gatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagccccaggctggagataacagcctcttgcccgtcggccctgcgtcggccctggggtaccatgtgccacaactgctgtggccccctgtccccaagacacttccccttgtctccctggttgcctctcttgccccttgtcctgaagcccagcgacacagaagggggtggggcgggtctatggggagaaagggagcgaggtcagaggagccg

SEQ ID NO: 3021 - DNA, 5828 bp, Homo sapiens
  Genbank Accession No. S62539
cggcggcgcggtcggagggggccggcgcgcagagccagacgccgccgcttgttttggttggggctctcggcaactctccgaggaggaggaggaggagggaggaggggagaagtaactgcagcggcagcgccctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttaaaaaaaaaaaaaaaaaaaaaaaaaaaaa

SEQ ID NO: 3022 - DNA, 450 bp, Homo sapiens
  Genbank Accession No. S67070
gtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatggccagctgcccaccactccagaggtagcagcatccttgggggaagggaaaggtgcatggtccacaatgtatggtttggtcccatgggacatgtcatagccttggtttag

SEQ ID NO: 3023 - DNA, 1791 bp, Homo sapiens
  Genbank Accession No. S67325
gccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcacgacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatcaaacctgggaatccaaatagttggataacttagaataactaagtttattaaattctagaaaga

SEQ ID NO: 3024 - DNA, 1167 bp, Homo sapiens
  Genbank Accession No. S68287
gcaagcaatggatcccaaatatcagcgtgtagagctaaatgatggtcatttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacgaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtggtgtggatggtgatgcagaggatgtctctatgctggtgactggacacacggcctctggttaaatccctcccctcctgcttggcaacttcagctagctagatatatccatggtccagaaagcaaacataataaatttttatcttgaagt

SEQ ID NO: 3025 - DNA, 2330 bp, Homo sapiens
  Genbank Accession No. S68805
gaattcggcacgagcgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccctacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaa

SEQ ID NO: 3026 - DNA, 2124 bp, Homo sapiens
  Genbank Accession No. S69232
attccgctcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctataagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatactataaaaaaaaaaa

SEQ ID NO: 3027 - DNA, 1465 bp, Homo sapiens
  Genbank Accession No. S69272
gaattcgggtctcgagcaggaagtaccaagggaggatggagatggtaataatcagggttgggtggagaatatctgaggaaactgcacttgatttgggccttgaagagtaattgactggatttagatttatctagaaaggtcgttcccagcagaagcaacaagaacaacaagcttggaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttagggtggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattaaaaaaaaa

SEQ ID NO: 3028 - DNA, 2912 bp, Homo sapiens
  Genbank Accession No. S70004
aaaggagtctcggaggactgtaagaagaatgcttcgaggccgatccctctctgtaacatccctgggtgggcttccccagtgggaagtcgaagaacttcctgtggaggagttactgctctttgaagttgcttgggaagtgaccaataaagttggaggcatctatactgtgattcagacaaaggccaaaacaacagcagatgaatggggagagaactattttctgataggtccatattttgagcataatatgaagactcaggtggaacagtgtgaacctgtaaatgatgctgtcagaagagcagtggacgcaatgaataagcatggctgccaggtgcattttggaagatggctgatagaaggaagtccttatgtggtactttttgacataggctattcagcttggaatctggacaggtggaagggtgacctctgggaagcatgcagtgtcggcattccttatcatgaccgagaagccaatgatatgctgatatttggatctttaactgcctggttcttaaaagaggtgacagatcatgcagatggtaaatatgtcgttgcccaattccatgaatggcaggctggaattggactgatcctttctcgagccaggaaacttcctattgccacaatatttacaacccacgctacactacttgggaggtatctctgtgcagcaaatattgatttctacaaccatcttgataagtttaacattgacaaagaggctggggaaaggcagatttaccaccggtactgcatggagcgagcttccgttcattgcgctcacgtgttcaccacggtttctgaaataacagcaatagaagctgaacatatgctgaagagaaagcctgatgtagttactccaaacggcttgaatgttaagaaattttcagcagtgcatgagtttcaaaatctacatgccatgtacaaggccagaatccaagattttgttcgaggtcatttctatggtcatctcgactttgatcttgaaaagactttgttccttttcattgctgggaggtatgagttttcaaacaaaggagctgacatcttcctagaatccttatccaggctaaatttcctgctgaggatgcataaaagtgacatcacagtggtggtgtttttcattatgcctgccaagacaaataatttcaacgtggaaaccctgaaaggacaagcagtgcgaaaacagctgtgggatgttgcacattctgtgaaggaaaagtttggaaaaaaactctatgatgcattattaagaggagaaattcctgacctgaacgatattttagatcgagatgatctaacaattatgaaaagagccatcttttcaactcagcgacagtcattgcccccagtgaccacgcacaacatgattgatgactccaccgaccccatcctcagcaccattagacggattggacttttcaacaaccgcacagatagagtcaaggtgattttgcacccagagtttctatcctccaccagtcccttactacccatggactatgaagagtttgttagaggttgtcatcttggagtatttccatcatactatgaaccctggggttatactccagctgaatgcactgtgatgggtatccccagtgtgaccacgaatctctccgggtttggctgtttcatgcaggagcacgtggctgatcctactgcttacggtatttacatcgttgacaggcggttccgttctccagatgattcttgcaatcagctgactaagtttctctatggattttgcaaacagtcacgccgccaaaggattatccagaggaacagaactgagaggctctcagatcttctggattggagatacttaggcagatattaccagcatgccagacacctgacattaagcagagcttttccagataaattccatgtggaactaacatcaccaccaacgacagaaggatttaaatatcccaggccttcctcagtaccaccttctccttcagggtctcaggcctccagtcctcagagcagtgatgtggaagatgaagtggaggatgagagatacgatgaggaagaggaggctgaaagggatcggttaaatatcaagtcaccattttcactgagccacgttcctcatgggaagaaaaagctgcatggtgaatataagaactgaattcatgtgctgcatgaagagctaatttaaaaaagcaaagtaagactaattatttaaaataaaaatgccacaaatttcattttctccttctaagtattacaatggagtttattctctgcctaaaaagtggaagaaattgagtgaatgataattttgtaatttaggataagatccaagttattttccccaactcttgtttcccccataaagttaggcatgaggaggagcactcattaaaggcagaagacggaaaagtgtttttaaaatggtgaatttaagtggtaaggattttctcttactctgtttatttttaaatgatcatcataatcctttgcttactatttatgcagcttctctaccccaccacacaaatttcccatttcccccccgaaaaccttgatcttacccatgaatgtgcactacctacattttttaaatagctaggtttttactgattattttcatttttcacatgcatcagaaccatgatttagatgtagttttacagagacaaaaatccatgagtgaatagctatcctaagtccatattttgatgcatattaatggacatttatgtcacttttgaaatctagaattgatgttgtaattaatgcaagatattaccatgtacatggtaccaccatcttactgtaacatttttctattgtttaaatagaaagcctttttaaaatttggtcaatcttcatagatgataacttgtaaaatccaagtaaataaacacattaatatttaataacttaaaaaaaaaaaa

SEQ ID NO: 3029 - DNA, 4017 bp, Homo sapiens
  Genbank Accession No. S72370
ggcaggcagcaggcctcaggccagacttgggtgttacaggaacagtgtggcctctctggaactctgcagaccaactgccgtgatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattggtccaagcccagaagtggtccgcaagatgggagacaaggtggaggcccgggccatcgccattgctgcgggtgttcccgtggtccctggcacagatgcccccatcacgtccctgcatgaggcccacgagttctccaacacctacggcttccccatcatcttcaaggcggcctatgggggtggggggcgtggcatgagggtggtgcacagctacgaggagctggaggagaattacacccgggcctactcagaggcctggccggcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgaaggcaggagcctacccgacctggggctgcggcaggagaacatccgcatcaacgggtgtgccatccagtgccgggtcaccaccgaggaccccgcgcccacgttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgtgtccgaggtgtgaagaccaacatcgccttcctgcagaatgtgctcaacaaccagcagttcctggcaggcactgtggacacccagttcatcgacgagaacccagacgtgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccgtttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggctgaagcgctggtgcgagctggcacccacatcctgtgcatcaaggacatggccgggctgctgaagcccacggcctgcaccatgctggtcagctccctccgggaccgcttccccgacctcccactgcacatccacacccacgcaccgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatgggggtttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagactcaagatgtcccaggtcctgggaagtttactcaataaagctggctttcccctgccctcccatgcagcaaaaaaaaaaaa

SEQ ID NO: 3030 - DNA, 2444 bp, Homo sapiens
  Genbank Accession No. S72904
tggatagagcgaggagaggtcaaccgtcgtagcgccaataacttctactccatgatccagtcggccaacagccatgtccgcctgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcgaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggactcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaaggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggacccattcagaaactttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcaaaaaaaaaaaaaaaaaaa

SEQ ID NO: 3031 - DNA, 2149 bp, Homo sapiens
  Genbank Accession No. S73885
gacctgcaaacacacacacacacacacacacacacacacacacacacacacatacacacgcaccagggcagccgagagacctccctcccgcccctcccatgcccgcctccctcccctcgccgccgccgccgccgccagcatctgggaccggccgattctgcacctccgtccggcgctgccctttgattcggatttccatcttgcattctccggctgatcgcgggacctggctcgtgcagaggaggggggccgatcgctatggagtatttcatggtgcccactcagaaggtgccctctttgcaacatttcaggaaaacagagaaagaagtgataggagggctctgtagccttgccaacattccactaacccccgagactcagcgggaccaggagcggcggattcggcgggagatcgccaacagcaacgagcggagacgcatgcagagcatcaacgcgggattccagtccctcaagaccctcatcccccacacagacggagagaagctcagcaaggcagccattctccagcagacagccgagtacatcttctccctggagcaggagaagaccaggctcttgcagcagaacacacagctcaagcgcttcatccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcaggtgcgctcgctggaggcccacatgtacccggaaaagctcaaggtgattgcgcagcaggtgcagctgcagcagcagcaggaacaggtgaggctgctgcaccaggagaagctggagcgggaacagcagcagctgcggacccagcttctgccccctccggcccccacccaccaccccacggtgatcgtgccagcaccgcctcctcctccctcccaccacatcaatgtcgtcaccatgggcccctcctcggtcatcaactctgtttccacatcccggcaaaatctggacaccatcgtgcaggcaatccagcacatcgagggcacccaggaaaagcaggagctggaggaggagcagcggcgagctgtcatcgtgaagcctgtccgcagctgcccggaggcccccacctctgacaccgcctccgactccgaggcctcagacagtgacgccatggaccagagccgggaggagccgtcgggggacggggagcttccctgactacccccccagccctcctctcccttctgggggctggagggagccggggcagccacagggagagacatgggcgaatgagtgagaaatttttacaaaattacgatgtcatttgggtctcttttatgacctctttttcaatactgtaaatcgacctttgaacgaagccactcaacccgaggtcccggggctggggtgtcgcagagctgtgggagcatcggcaccccagggcggggcctcggccccgggggctggaggaagctgacacggagatgcctggcctctctctgccaaaaagcattttttcctttaaatatgttttttaagaacagggaaaattaaacaaaaccccaggttatttcttccctgcccagagccagcctgggattgtcagccttcaatcccctttccttcctctttttgggttttcttctttctcctttaagcacttacatggttgggggtaagactaggctggggcattctgggggcccggaggtctccgttgcttcttggttggggtttgctgctgctgtgcccccctcccccttccccatctcggcactagaattcgccactctcccaccccccagcccccacctctgcctccaggtctcatcttccaccccaaaaatgtctgtctctctctttttgttttgtttgttgttggttttttatttctttttggtttgctttctgtttttgttttgtttttcttttttttctttcttttttttttttttacaattttgaggtcttcgtgttcaaggagaagctattatattttgttaagaaagtggggagaaaaaaaaccaagaggccaccgtgcctttgtaaagaaacaaaataaagtttgtactttgttttttaaaaaaaa

SEQ ID NO: 3032 - DNA, 1809 bp, Homo sapiens
  Genbank Accession No. S74728
cctgctccaaggtccagagagctttctggtctttgcagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccccgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagactttcgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaagattaaagttttccctgaataaatgcattattatgactgtgacagtgactaatccccctatgaccccaaagccctgattaaatcaagagattccttttttaaaaatcaaaataaaattgttacaacatagccatagttactaaaaaaaaaaa

SEQ ID NO: 3033 - DNA, 262 bp, Homo sapiens
  Genbank Accession No. S77356
gattgcgtgtgtgatgctagggtagaatccgatgtatgttggccttcttacgagccaaaacctgcccctactccccaaaaaaaaaaaaaggattgtgcgcattggcgagaaatgatcgttgacatgtctgtcaagaccaagattcagaagctgggcagggctatgcgggcagattgtctaaaagtgttggttttctgccatcagtgaaaattcttaaacttggagcaacaataaattctacttcctgtccaaaaaaaaaaaa

SEQ ID NO: 3034 - DNA, 2268 bp, Homo sapiens
  Genbank Accession No. S77410
accccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagtt

SEQ ID NO: 3035 - DNA, 3118 bp, Homo sapiens
  Genbank Accession No. S78187
ggggggggggggggggggagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtgaccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacacctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaaaaaaaaaaaaaaaaaaaaaaaaaaaa

SEQ ID NO: 3036 - DNA, 6204 bp, Homo sapiens
  Genbank Accession No. S78569
tagcgctggcggggcctcaccccaatccgtctgccttttgatgccgtactctgctggttgcgcacgcacctcgggatactgcacacggagaggagggaaaataagcgaggcaccgccgcaccacgcggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttccagaatcctgctataggaaaaatggagctgttcggtgcatttgtaacgaaaattatgctggacctaactgtgaaagatgtgctcccggttactatggaaaccccttcctcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacataccaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagtaacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagaggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttctttttagcccttttgtttggtctatcagtataagaagaatattttaggtttatagctgaagttatcaaggtttaataaagtaaatttctaaca

SEQ ID NO: 3037 - DNA, 1223 bp, Homo sapiens
  Genbank Accession No. S81914
acactcgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcggctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgcgggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgagcacagcccagctgggctaggcccggtgggaaggagagcgtcgttaatttatttcttattgctcctaattaatatttatatgtatttatgtacgtcctcctaggtgatgagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcattctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgc

SEQ ID NO: 3038 - DNA, 833 bp, Homo sapiens
  Genbank Accession No. S82240
cagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgagtctaaatgaagtgcacagccaaagtcatgtataccagaggcttaggaggcg

SEQ ID NO: 3039 - DNA, 2403 bp, Homo sapiens
  Genbank Accession No. S90469
ggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgtcggggagaacggcggccgtgcgctggtgcccatgttcgtgcgcaagtcccagttacgcctgcccttcaaggccaccacgcctgtcatcatggtgggccccggcaccgggtggcaccctttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggagcctctggccctcggtggctgcacagaagggctctttctctctgctgagctggcccagcccctccacgtgatttccagtgagtgtaaataattttaaataacctctggcccttggaataaagttctgttttctgta

SEQ ID NO: 3040 - DNA, 2347 bp, Homo sapiens
  Genbank Accession No. S95936
  unsure (1)..(2338): n = a or c or g or t
acggcgagcctcatcctccgggtgcggcgctgagcagcgagtcncgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcaggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttaaaaaaa

SEQ ID NO: 3041 - DNA, 250 bp, Homo sapiens
  Genbank Accession No. T03313
caaataggacataaaggtccctagatttttaatcaaaatattttacaatttttgctctgctagcatgagatcaacaagaaaacccaacaggaatacataaaaaacttaacaagttgactttaataagtaaaaattacaacattcttctcccagcaatgaacaatttcattttttaaaagtaaacgaggcctaaaacaagagggcacaggaacaagtagtcagatggatttaggtgagcactgtacacaag

SEQ ID NO: 3042 - DNA, 322 bp, Homo sapiens
  Genbank Accession No. T03438
caggtaacaatgagacatatgcagctttatttaataatctgtaaaaagtcatactctggcagagtgatgcattccttatctcagcagaaagcaaacagtctgtctgaaaagccccttcccaagatttggaactgtgtaaccctgagcttacatctcaatgctcccaagagctgggctcttgctatgtggtagttggtctccacaattctctcaccctccagcaatactctctgtctggctgtgactccctcacctaacagtagacatgaggctgaaaacaactttacctggacagggctacccctacagtttggccctttct

SEQ ID NO: 3043 - DNA, 252 bp, Homo sapiens
  Genbank Accession No. T03441
  unsure (1)..(252): n = a or c or g or t
cagattcacttcacttttattatgaacaaacacaatctcagattagtacaattagcttcagagttgatattaatagaaattattccaaatttatccttgtcacaagtaactactatatcccacataaaaggggaaaaaagcccacccaatcacagaaatgaggcatccccggtatgtttccggggcaatgcgttgtttatgtattgcccaaatttngtctggctagttatccaccgcttctccaatggattc

SEQ ID NO: 3044 - DNA, 304 bp, Homo sapiens
  Genbank Accession No. T03541
  unsure (1)..(304): n = a or c or g or t
gaggtgtccccaacaattttattataaataaaaacaagactcccagtgggtggctgcagcccctgcctcggtggctgtnagcacctnttggaggggcctgcccttaccctggtctggaggccagaaccgaggaaagggctncctgcccctccaagtacacaggggagcctgaggtactgagaattaaaaaccagggagggactcccaggccaggcggcggccccgggccctctgccccacgaggctcatcccttggagcacacaggaagttgcccgtccatnacaccacacttttttncagncg

SEQ ID NO: 3045 - DNA, 275 bp, Homo sapiens
  Genbank Accession No. T03580
  unsure (1)..(275): n = a or c or g or t
cacctgttgtcttattgacaaacaggtaggccctatagcaacaggcctggaggtcctgcagtagtgggggaaaatggaaggtggagggtggagtttttcctgcaggacagctgagtggagggtggggacaggtgcaaactggagaggcctagagagctagagaagcaagtaagggccagggccagagtcggtttcattggaacaacagcccattncccttaaggccccttaatttttgtcttggcttttttcttagaccccaagccaggtttttt

SEQ ID NO: 3046 - DNA, 169 bp, Homo sapiens
  Genbank Accession No. T03651
  unsure (1)..(169): n = a or c or g or t
ctacacatgnttttttattagtatagataccttcacagacaatactgtaattttaagaggagttccacatcattacatcaacagtgtgaatttctaacagaggcaaaactgagcaccatagtttacaagnagaaagaccntgnttgnggacaacagangttcactaagg

SEQ ID NO: 3047 - DNA, 401 bp, Homo sapiens
  Genbank Accession No. T03749
gggcttggggggtttattaagtgatgctttagtctcagtctctgccagcaactgggagtggggtgactccactcaccccaggatttcccagacttgctattttagaggagagaggcaggaagccaactatcctctaagccacagcttgggaagctaggctagtactggggtgggggcagcagagctgagaccctccaccccgagcccctagcctgtgctatcctcccagcctgagggggaggagctgaggcaatcctggctgcagcctcccacacacagccctgctcttggtgcgccattcactgccctgagctattcatgatctctgctcccagatattcacctcaacactccaaaagccagccccttcaggtcttcagtcctgcggaaggcaaaaggag

SEQ ID NO: 3048 - DNA, 371 bp, Homo sapiens
  Genbank Accession No. T08879
  unsure (1)..(371): n = a or c or g or t
tgttgaatgaggatcccctgtcccaggacttgcctgtnaagatggcttcaatcttcaagaactttgtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctngccccacctgaatnggactggaggagtaaggggggcttgtcacaaaagtcaaagaccagggcatgt

SEQ ID NO: 3049 - DNA, 339 bp, Homo sapiens
  Genbank Accession No. T10108
tttagtatttataatcatttacttgtagcgaactgtttaaagttaacacttgtttaaatttttttacactatagcatttatgcaatggtttacagaattcatggagttatttttatcagtatgggaattaattaaaaccttgaatctttgttttggctgcttctctgagcacaagcctggtcagctggtccctgcgggtcctaccagccagcttctctgtaggggtctcgggcgcgtccacctctgctctcccaccacaagggtcacaaactcccacgcaggcctgggtcacccgcagctgctctggagacttgggctctgggcgtctcgtgggccaaa

SEQ ID NO: 3050 - DNA, 319 bp, Homo sapiens
  Genbank Accession No. T10264
tttccagtataaattatttttaattttagaaactgagattgaagtacagtttttagtttaaaatattaaaaatgaaaaaacctttaacattattaaagatgtgttgttacaaagttcctagatatatacatgtacaaaacaaatagatattactatctgacacctcaacccatgacttaccctaaatctcctgatatgaacaattaatctactgggaggcttttcccaataagtttcaaatttcttgcacaaagatttgctgccattcatattctgtgcatggatgaggacatttaatcacagactatttcaacttaat

SEQ ID NO: 3051 - DNA, 319 bp, Homo sapiens
  Genbank Accession No. T10316
tttagcggtctgccttcatcttttaatggccggtgcggtacagttagtggacagacgggggatgggacacagcaggggtgaaacagggcagtcacagccggggccggggatctggaagcggggggggtcctccccctggaaacaccgtctctggaaggacacccttaggatcccctgacctcagggtgccacccacacgggcctggtgttctgggagggccgggctggagtgaccccagcccctccctacgttccagggacccttgggtctgtcgagtccccttggtggatgagggtcaagacctaggtcaagctgact

SEQ ID NO: 3052 - DNA, 299 bp, Homo sapiens
  Genbank Accession No. T10322
  unsure (1)..(299): n = a or c or g or t
tttctgagacactgtcgatttattttagcatttacatttgacattcatttaacagacacacaaggcaagccaacaggtaaacatgcttacacagcctgcagaaatcgccaggttttancttgttttttaggaaaacaaccaaaacacccaaaatttaccatgacccggtacaggaaaaacaggaggactcaagtgattactagagctgcaagtgtttcttagaattgaaccaaaaattgttttttcccaactggttcaaatttcctctaagtgcaggtgagaaaaaaggcaattatatt

SEQ ID NO: 3053 - DNA, 232 bp, Homo sapiens
  Genbank Accession No. T10698
  unsure (1)..(232): n = a or c or g or t
tttccaaactcagagcaactttcttgtcagcgtgggcggacgttgggaggcacctcagtcatgatacaggcgcaggaggcagccgcggagggtgcccatgtagcggtcccagagggcctggtgtcagaagccatcagaggagtggatagacgctgaatactaattcaggaagaaccgcacgtcgctgagtggccagtggtcggagcggnccagggttcacaaacttctcaca

SEQ ID NO: 3054 - DNA, 237 bp, Homo sapiens
  Genbank Accession No. T10822
cataacattaatatttattgctttatatgaatactgtattgaaagcccaagcattcagtttacacacagaaattatacaattatataccgcttcacaaaggcagtgaacacattacattctacaaatctactttacagaaatttgaaaactttaaatatcaaaaggtacagctgaagaaacaggtataaatttggcagccagtaattttgacagggaagttacagcttgcatgactt

SEQ ID NO: 3055 - DNA, 140 bp, Homo sapiens
  Genbank Accession No. T12599
tccagaggtcttttatttttttaacacccacgatgccatgaattcatagggaagaggttccagcagctcaggctccttcccattggttctcacagtgtgctgctctgggtggagcaggctggcgcttcagttgaatccag

SEQ ID NO: 3056 - DNA, 190 bp, Homo sapiens
  Genbank Accession No. T15442
cacagacagatgtggggcctttaattatttggggttcctctatatggaacacgggacctccccaccccaagcctagtgcctttggaacccccataaccagtacaaaagtccctgaagggtcccctttaaaatcactaatttaaaaaaggggcgaagggggggagggcccgccccccaaaagggttgggca

SEQ ID NO: 3057 - DNA, 223 bp, Homo sapiens
  Genbank Accession No. T15473
cttaaacacacaggtgtttatttaattgttcatttgattgaatttttaagttcactttactacgtggatgagatgggtgcatattacagtaggctttcgctatgagcgctgccaccatgaggaatatcccagccctcagttctgcttccctttctgagtcccacaaaagccagatgtggacagccttgggttcccatcccagctggctgctccttctggggct

SEQ ID NO: 3058 - DNA, 282 bp, Homo sapiens
  Genbank Accession No. T15477
cccaaaaatacttccatttaatatagtcatatgaaagctaatcagcaagaagggagattgacagacatgcttaggaaaatagctacgtaccataccaccacaccaaagtgttgttttttgtttttgttttttttttaaacaaatggagaaaagacagaccagccaggatgacttcccacagggaagggatttaagggctgcccccatgaatttcttcaggccacggcagctacttcctcctcttgtatctggatttagatttaaagtttcctcctcgtctct

SEQ ID NO: 3059 - DNA, 281 bp, Homo sapiens
  Genbank Accession No. T15482
  unsure (1)..(281): n = a or c or g or t
agtgtaataattttattaataaaacgaacccatagggttcaaacaagcatacaaagtaattcccttccctgtgggttaaattgttacatttttaataataaaactaaganagctttcatagttaacttaccaaaaacataacgcttgcctattgtttcttactgtgcaaaacaaaaccaaagttttgcccacaganggnttttgtgcaccaaancatgcacatttncaatttcaaaatttctgcatcaaaatgnaaattccaaggccacgtttttgttttt

SEQ ID NO: 3060 - DNA, 305 bp, Homo sapiens
  Genbank Accession No. T15674
  unsure (1)..(305): n = a or c or g or t
gcaacgcaaggtgctctttattgtcagcgagagatttaggccaaacgggcactgaggctccacgtggcccaggccctcttccgtggaagagaggcaagagctggtttcaggattcagaggattcctccgctcacgcagcaccatgcaaatatagagggtaaaaactttctggnatgtctctggcttgaaaccaactgggccaacaggttccacaaccactctcttttttgatcactgggngacaccagaaatgctgttagagtagttagtctgagtccacccngggccaaattctttgtcacctt

SEQ ID NO: 3061 - DNA, 194 bp, Homo sapiens
  Genbank Accession No. T15852
  unsure (1)..(194): n = a or c or g or t
ggaaaatgaacagtaaatttattgaaactggtttaggggcaggggatgggaggacagctgggggttttccaaagagaactgagggaggagccagcgcccggccaggngggagcgggtgcctggccacagaccctatctcaggcccagctncttctttccctgnctnctacttgaggaccacgtccagattccgg

SEQ ID NO: 3062 - DNA, 332 bp, Homo sapiens
  Genbank Accession No. T15903
  unsure (1)..(332): n = a or c or g or t
ccagatgcctgtaatttatttccaaaggagagctacagcacataggaaaatacacatggcttttcagtctacatttttacagagaaaagtgtttcggtcattggctttctcagtgccatcatcccgttccatgaggctccagggtggatggcctgtttccaagatccccctttcaaagcagcagctttgccaaggcctctgggggtaggagtgaagggcagcgacccccattttcgggtggaggggtggacattagcagcactcactttaaagctaaggcaaagattagagcttngtgggngatgccttccctttccccaggggcatggctt

SEQ ID NO: 3063 - DNA, 365 bp, Homo sapiens
  Genbank Accession No. T16175
  unsure (1)..(365): n = a or c or g or t
ccacgttgctgttgttttaagaaaaaaaacaaaacaaaacaccacagatcaagttttctaacacctcagtttcaagattgcacgtttcacatttctcagtaatttacaggcgtccacagcgagatgttgcttagtgctagctggaggggcaagctcaggtctagaagggagagatgggtccgggtggagcaacacagttgggccccagggagtcttggagggacccaaggaagcagagggttttgtctccagtcctttgggaggggtcctctcctcctccaggactcatggctctttagcctagggatgggggaggcaggactgttggcagcaacctnancaagcctggatatgggttccagagt

SEQ ID NO: 3064 - DNA, 290 bp, Homo sapiens
  Genbank Accession No. T16206
  unsure (1)..(290): n = a or c or g or t
cacactacaatagttaatttaatttgtncaagagctcagattgcaagcattaaaccaagcatatggctttaattctntaagcccaaatccacatattgaagaagatcaaagcaaactgtgatccatgtacatggttgaaaactaaaggctcgngttaatcacattgtagttttnaaatttctacagcctagagctcactagtcacaggtctttaaggtccttctggttgtcccacagggtatctgcactttctttgagctgtgcaacctcatcatccttaagcttctggt

SEQ ID NO: 3065 - DNA, 252 bp, Homo sapiens
  Genbank Accession No. T16226
  unsure (1)..(252): n = a or c or g or t
gggcaaagtgaacccagccccagtttattagaaaaggtgtgaacagagttgcaccgacaggagtagccccagccctctgcccaccctcacccacacccatgccactcgcccccaaagggctgtagtgcctctnagggcgcagctccagtggcctggacagcagggtcccggagtgccggctgctcccgccccagctccctgatagatttattgcacttgagaaaaagaaagctctgatcctctgctcccatc

SEQ ID NO: 3066 - DNA, 373 bp, Homo sapiens
  Genbank Accession No. T16269
ctttcagctcatttctttaataaggagacgcattcattacaaaataacaatttgacaagagatcagacaagaacaagagtccacataagggagatggagagcattgccaagcagaagtgggaatgagagggccgggggcaagggctgtacatgtgtccttcctatggagacgaaggcagggctcctggtgggctgaccttggcgaagtaggctctgccaggccctgattttgaagttttcagccccagggttttcagaaagcagcaaatcaagtccttagatgggcaggagtcagggcagaagggtcactatctttgaagaggcccccctaaagtcctgatcgctaaggcaggtggggatggagggactcctg

SEQ ID NO: 3067 - DNA, 321 bp, Homo sapiens
  Genbank Accession No. T16306
  unsure (1)..(321): n = a or c or g or t
ccatgttcatttttatttaaagactcagaaacacaggcatcatggtttgtcatcactgacaagtcttccaaaatcacacgctgacatttgtgtctaacaaaaacacttgggatagggtgtgtgtgtttgtgtgtgtgaactgtgcaaagtacaaaggatctcccagtcggctgagcctgttttgaagtgcccggtctggcatcaccccatgaggatgccaggngagcacccgtggccgccatcctctctgcctccctctgggcagaggcccctggtggcctgcagtcctgtcccctcggtgtccactgacttcagccatgg

SEQ ID NO: 3068 - DNA, 340 bp, Homo sapiens
  Genbank Accession No. T16308
  unsure (1)..(340): n = a or c or g or t
aaaaatgtttttatttaattaaaaaaaagacagancaaccaacccaaaaccagtagtaggtactggngtcacaggtgcttaactggcgaaacacacaggggtgggggcgagggggcgggtcgggaggagggagagaaggtgggcacaggccaccacatccccccgttgggtgtcaggtctgagatgcagcgggagggccaggaatgggcggcccagggcccagggtccccggagacccagctggccgcggggagaaggctgagaaggcccgggtgtctnaggtggttttgctcccggctcgtccccttcttcctactctttcttggtccctaggttgggc

SEQ ID NO: 3069 - DNA, 346 bp, Homo sapiens
  Genbank Accession No. T16478
aaagcaatggaatcaataaatttattaatgttacattaacacgaactacaaagagacctttcgtatgtctgataccaaagacataactgaaaagtcatttttccaaaccttgagcttgcattcacctacctgtctaaccctcacatgtgctaattaactgcaaatgccatttctgggcttcacacacattccgtggctttcccttttctgatgtgacttccctcccttaccccacacctccctgcactgtcccctgctgtgcccttggctggaatgccctgcagcctgcttcagcccagcaaagtattcatcttaccagtcccatgccctgactcctgatgtcacc

SEQ ID NO: 3070 - DNA, 288 bp, Homo sapiens
  Genbank Accession No. T16484
aaaaataaagcctctttattggtacctgtaagctcaggtacaaggtgttcccacaagcacacaggctggcaaggcctcctgggcaaggggcaggcccagagcctgcgtttcttggcacagacacagagagaaatggaataaattatagttctgacactcagggacaatgtagaaattatgatgcaaaattaaacattagcaaacaaagggtataaaaaccctcaggagccacccctcgccaactggcctcagggcatgggcaggtgggccacggttgaagtgcagtgc

SEQ ID NO: 3071 - DNA, 244 bp, Homo sapiens
  Genbank Accession No. T16550
cacaaaatggatttttattgtggtcatacatggtttctcagtgccacagaaaattgctatgtagggacaaaaaatttttggatggctctgtaaagaaacatggtaggttttcagaaatgagttgtgcaggaatgtggttaatgaaaagcagaaagggttaagggaagagaaaggaagccaaggagtgtggtatgtacatcaaatgattactttttaagcccctctaggctctgataaccctttc

SEQ ID NO: 3072 - DNA, 266 bp, Homo sapiens
  Genbank Accession No. T16652
agtgtggcagatgtttattgagctagaggaggagagctgagctgagcccagcctgatcacctcctcagagactcagcattgtgaattgcccctacagggtcatttttatacagcatgaagtagccctgcacctgggcaggactgatctggtttgtagctcgaaggacatgttctgcaaagttctcagctaaggaaggtgcctgccctggatagaacctctggaacatctgggtcagctgccagtgtgagcagtagcccacgtactc

SEQ ID NO: 3073 - DNA, 269 bp, Homo sapiens
  Genbank Accession No. T16983
  unsure (1)..(269): n = a or c or g or t
aaaaaacaagctttaatccatttcataaaanttgtccttgcaattgancacagccaggcccacatgcccagcaggttgcaggngacagtttcacatttnccaggctcaggacagggcagtntcctccacatgccacaggtgtctgagtgacagtgtagacgcctgatgggcaggaggtaggcacagatgatctgaaggggtcatctatttaaaagtctgcaactccagttcaacggncaccttaaacactgtcaggcacgtnccccaag

SEQ ID NO: 3074 - DNA, 394 bp, Homo sapiens
  Genbank Accession No. T17066
  unsure (1)..(394): n = a or c or g or t
agttttnnacatattgttaaaagactttcaagaaataatacaaactggagatagtagatacacaggctccattctaagaacaaagtctgttagaagcaggaacacttggacaaatatgggatgggagggatgtcaggccgaggttagagtggtgatctctccccaccctttagggcctttggaggtggagaagggatcctgcctgctagcaccacattggaagggatcatctggtccagaacccccatttctatcaactaggagctggggggagtagctagcccagagacttcgggtcagggttcancaatcagggaagacccagttcctgngggaaacgncagttcaagaagngtttgggaagaaggctgtcctctaaagaaggccgtcctct

SEQ ID NO: 3075 - DNA, 248 bp, Homo sapiens
  Genbank Accession No. T17339
  unsure (1)..(248): n = a or c or g or t
ctgtaaaagcatttcctctgaatattttattcagaaaaaaaaaacacaaaaagataaggcaganacaaaaattccagtcatttgcagtatctgtcggctttcaatttggttctcttgtttaaacaaagaaaaatagtaaaattaatctatgtaaaacatgccatatatattcaactgctactaaatataaaangctttaaaactgtgtgttcaattgtggttattgtattaccncaacacatattaaa

SEQ ID NO: 3076 - DNA, 325 bp, Homo sapiens
  Genbank Accession No. T17353
aaaccaaaaatattttattgctgagtcatcctggggttccataaaggaccccaagccttgcttggagtctatagctttgctaggactcccatgacatcaggatagagattgaggcacggggtcctttgggttccgattaaggaactatctactctgattctgttgatcttattagtccctccaggtcacctctacttcatctgtccgatacctctgtgtaaccccagaatcactgagtggggtcctgtgtccagcccgaaacatctcccagccagcctgggctatcatcgctccattgtcaatacagaatctctcatctgtagca

SEQ ID NO: 3077 - DNA, 319 bp, Homo sapiens
  Genbank Accession No. T17411
  unsure (1)..(319): n = a or c or g or t
gcctttnacaggaatgttttattgtctctncctggncttctaacatagcatatgaggngaaaacactgctttagtaaaaatggaatactcttggttacatgaaatcccatccctcgtccttcaggtccactggaggagaagtccctcattccttgggattggtgacgncagccgtggtggaataggagtaggggntcagcagggcggcaatggtntagcggcgggggccggagtcgttggctgtgaataccacctatgagagaagacagncagatccntttccaccagagcccgnaaancgtgacagttgacacacatg

SEQ ID NO: 3078 - DNA, 319 bp, Homo sapiens
  Genbank Accession No. T23426
tttaaaataatgaatcataaattttatttcaaaatgtaaacgtcactaaacatgcatacacgttaaaacaataaaatttacaatttcgttaatttttctttttggataggacatcattacaatatagaatctatgccatacaaaatacatacaaagttttatccgagcaagccaaggccagactgggaactgtacaactgtaatacttcactgtagtgatccaggaaagatgaaacgtggccttcggaattatggtgggtgctggttaaaaaaaagttcctacagaaaagaaaaacatgagctccatggaaatggtctt

SEQ ID NO: 3079 - DNA, 337 bp, Homo sapiens
  Genbank Accession No. T23430
tttaatatttatcaacagtatatttgacaaaaaccacccccaatcgatggcagaaagcagtattttctagctggcactgaaacttaacctatttttttgggggagaaaaagactaaaatgtaagcactaacttcctccttctgcatcttccacagaagacccacttgtgggcattctctttctgtccgttatcagtgggtttacatccgaaggccggcggcaagacacttgaaccacaaacaccagacatgcaggtgtctcaaatggcatgcagattatttaaaggtgcatcacttggtgagaagcttctcaaatttcttgacttgtcataaccagg

SEQ ID NO: 3080 - DNA, 249 bp, Homo sapiens
  Genbank Accession No. T23465
tttcgcggtggaggatcaggtttaatggtcactatgagggtatcgtacatcgttccaagcccggcccccgccccagccctccctcagttgggaacacagccaggtgccctcagacccctggttctgaacaagggggggctgccccctcgccccagctatatacacgacagcccatcctgctggccgtggacaaaagctgggagctcctgtgcccagtcaggagcccctacagtccaccagctgcgcggg

SEQ ID NO: 3081 - DNA, 299 bp, Homo sapiens
  Genbank Accession No. T23490
  unsure (1)..(299): n = a or c or g or t
tttccaggttgacaggttttattccacccccttccatccccatggccaccccaggcaggaggagacaggtgtgctggagtctggtcactttggggcccggcgtgggcagagcccactgggtttacattctctgtgggcaggtgtggacaccagagggctggggcaggaggagcgtgggagcgagcggncgacccccgtctctggcccggcccctgggtaaacgccgactcagatgcctgaaacagacctgggccgagcaaggaaggttgatggtatttccacccagacagaaattcaaa

SEQ ID NO: 3082 - DNA, 219 bp, Homo sapiens
  Genbank Accession No. T23516
tttgggatctcagaaaggtttattatcaactgaaggaggtaacatgtagcctttgctggggacaaagatgtgacaagtctctgccccatcctaggtgctgccctgcgtagggatcttcccaggcccgccccccttgggaagcctggtagcgctgggctggcgtggaatcctctggctggatccctcgtggttgctgggttcccgccagggccaatactc

SEQ ID NO: 3083 - DNA, 349 bp, Homo sapiens
  Genbank Accession No. T23680
tttcggttggttacgacaaggcaaaacctttaataacatgagtgcttattacattagctgcttcggggctctgacatctttgatttctggtcatgtttttctaacacataaagatgaatgcctccctcagggccacctgggcggtggttggtttcctgaggatttgtgtgggtagacaatggggacaactatgagcgcgcctgatggagattcggaaatcccccctggccaccacctgtgacttttagtaaagtcctcttccaaggagggaagaatgtggaggtccttccagtaaagaaggaagaaaggaaaacatctggcacagatacacagagagaggaatgacatt

SEQ ID NO: 3084 - DNA, 307 bp, Homo sapiens
  Genbank Accession No. T23882
tttagagttagaacatcaagactgatctttatttcacccagaggcagagtgataaaatggcattcttctctatttaaattctatcccatctttcttcttgtccttcctctcaaggttgctggcagaggtggttggggctatgtgcctggagtgaagattctgcccattggtcaagagacctccctctcagatgctggctctgcccctgcctttgggggtcgacccttgtactcgcaggaccttaggtgactagttgtttcttcttttatttcccctattcgtgatgatcggaaaggtgaaaaacctg

SEQ ID NO: 3085 - DNA, 349 bp, Homo sapiens
  Genbank Accession No. T23986
tttatgggaataaatacttgttaaacttctcttataaatatgcattaaaacgtccgataacacaagccaagggctgtaaaattaaggttaaatcaagactgaatttcccgcacggaccagcaggaaagccagttacctaaaagagcctaatccccaaatccgctgaaggtgcagggcggcctcagtcccggggcatcttgaactggtccttctccctgcgcacggcccgcatggtggtcaccgggtccgtctcacctgcgtgctgctgcaccgtcttctccctcactctcatgaaggggttgtaggtaaactcctctgccagggtggatggcactgtgggctccccgat

SEQ ID NO: 3086 - DNA, 299 bp, Homo sapiens
  Genbank Accession No. T24055
tttatcttttcatcaccattatttattatatatgaaccaggttttcagcacaagtcacactcaacacccttacccaacaggaggggcgacggaggctcagagagggagtgtagggggaggatgtcaatgggaggccccagcctgagccctgagcagctggccagccaggaactggcattgttgagtgagaggcatcctagtctcctgctgctgcaaagacaatgcccgctgaacaggatggcaggccacatcagcagtccatacagaagtgaggctgtcgtttcttcccctggagcacc

SEQ ID NO: 3087 - DNA, 349 bp, Homo sapiens
  Genbank Accession No. T24068
tttcaggtaacaaagtccagtctgttttatttttaacccaaatattccaaatatacagaaaattaccagtacaaagttaaacacattcagatttatttacacaatgctaaagaaatttgagttttatttccattttgtggaattttatcatggggtctggctttaatgtgtaactgacgtgggtcactgaaactcgattatcccacctcacatgcaattttctgtcctaagggaatagaaaacttgggtttttagggcacatgcagtaatgatcttaatactgctttacactttcgtgggaaggcagctgtcccacagcctggggaaggaccacatgctcagaaagggg

SEQ ID NO: 3088 - DNA, 149 bp, Homo sapiens
  Genbank Accession No. T24106
tttaacaataacttatttattttctaggccatgggagggctttgggatacgattctgggcccgaggactcaaaagggggccgagggtcactgtcagggggtctgcgtgaccacggggtacagcagagccagatgctcggcgccctgcac

SEQ ID NO: 3089 - DNA, 150 bp, Homo sapiens
  Genbank Accession No. T25506
aagagatcagcttttattgatggaaattccaaagtacacagcaacacgcactctgagaggccttttcctcctgataatatttacagagcactatgggagtggcagagggcatggggtgaggccttcaagcagtggaggagaggcagcaat

SEQ ID NO: 3090 - DNA, 143 bp, Homo sapiens
  Genbank Accession No. T25725
gcaatttaaataagatttatttttttaaaggtggttatttttattttttccaatgccacagttataggagtgtatgaagaggtaacatgtctccttttccttaaccatgttttttttttttccttctgcacaaaggtaaaagt

SEQ ID NO: 3091 - DNA, 244 bp, Homo sapiens
  Genbank Accession No. T25744
cattttaaaaatcattttattgtcatttcatggttaaaaaaacatacatgacatgactataaagtaatgagacgagttctcaggtgtgggttggattactgagtctcattaatatatagtcacaatcctgacttgagcttggaagaaaaatatgccttcgctatatgattatcaattttgttacttaaaatttattgagtgccaacagagcactaggcacatatataacacagaattatacagt

SEQ ID NO: 3092 - DNA, 223 bp, Homo sapiens
  Genbank Accession No. T26366
  unsure (1)..(223): n = a or c or g or t
ccaaggccccaggggggttttatttttcctttnnaacaacccgtncggggggttcccggggtcttttggcccgaatgccgaagagccgggggtgggaacgggccaaacggagactagcgaaggttttgaaattgttctcttccccagggatgactcgagctttctccccctnaaagacgttccggacgggnaagaccggtccggtaaactaggggggccaatt

SEQ ID NO: 3093 - DNA, 301 bp, Homo sapiens
  Genbank Accession No. T26471
ttttttttttaaaagcacaactatatttgggcacgacggatttaagtttttcttgttgagaagagtacatctttccaaactggacatcaaggaattgctacacagaagaaccacatccaggatagaaaggaccagccagagctcgttcagtagtgtatttcagaatcatcagggaggagccggtagcagaattatcccgttaacactgagaccacatttcacctgttacttatttttctaaatggagtaggagagaaagatgctaaaatgtgatcttgggaggagtcccccagtcccccga

SEQ ID NO: 3094 - DNA, 611 bp, Homo sapiens
  Genbank Accession No. T26513
  unsure (1)..(611): n = a or c or g or t
ttttttttttccaactacttctagacctttatttctctgtgaaaagggggaaaataaaaggaataaattaaaaacggtacagttgacacacaaaaaaaaaccantgatggggaggacggtaggtggagaagtaaatgggggaggggttcccattacagnagtaggatccagtgacccgggatgctcacatctctccctgatgtgggaggagtagccccttcctcccaaggtcactgtcctgtccaaccccgtgctcccctagcccgttgggaggtggctcagtgagacatcttcccaggctggggagaggaggaaccctcctgggggaaggggnctggggtcagtccatccacagggagttacagccaaaggccccccccgtnttttccccaaaaggagggacttctttgagggttncagggttgatancagaggccagtgtttggtcctcttccaggatcaggggatatnaaagaacagtcagagcctccncggcaaagtttttgacgtccacatccttggcccggtcaaattcttttggttgggtagattccatctcaaagggnttcttgccaggttggcctttttcttaaggttttggccattgaggg

SEQ ID NO: 3095 - DNA, 407 bp, Homo sapiens
  Genbank Accession No. T26574
  unsure (1)..(407): n = a or c or g or t
tttttttatataaaaaactcatttgtttttaaaagcattaacaagacagaaagaaaagagaaaaggtatggagcagaacacaagccccttagtagtgttcggtgggaaggtgggatttttggttctctggaattgaatgtttagtgttttttatcaccaacanaaaaaaacaaagttaagggtccccaaaagcccacggttgttctattacccacaccccaccgagaaaaaagagcaccacgaaaagagcagaagaggacaagagagatcaagagtggagccaggtctggatggggcaattcaccctgtgcagtgtcctctcagggtcacagagagcaaaggctcctttcggcagaaaaggtagatgaaagtcgcaagaaatcgcaagggggaaangggtaatagga

SEQ ID NO: 3096 - DNA, 406 bp, Homo sapiens
  Genbank Accession No. T26646
  unsure (1)..(406): n = a or c or g or t
ttttttttttggagaaccaactcatctttattaaatgcatcgtgtgtgtgtgtgtgtgtgtgtgtgtgtgtgtgtgtgtatagcacatacttcaggcctgcggcaccaccccatagagatggtgaggaagtaacttctgcttctcattgaaactgtagatccatcggggacgaacgaatgccagggaggggttgnacatcagggtctcctcaaagntgggatcccattcctgtgctgagatcacaaactgaccccggtcactcatatagtcctcgagctccccattgaaggntgtaaagtatcggatgaatttccgcgcttcggcccccaggggaactccccccttaaagaaagaagtagcttggcccctgggaaaggaaatcttggggagcttcaagggacttgg

SEQ ID NO: 3097 - DNA, 333 bp, Homo sapiens
  Genbank Accession No. T30193
  unsure (1)..(333): n = a or c or g or t
ccgctcgagttttttttttttttttttgtgctcaaacattttaatcatttctgccctgtnactcccaccccagatccaagcgccanccagttccggtgggggctcagtcctccggagtccaggagtcagggctcgggggcgctcagcggccagtgggcaagattggggcctttcctgtcctcgaagntgcacaaaggtggncccagcccagancacagggagagggcagagagatgtgctcatcagtcttggcaggcgggccgggagcagtcttccagaaacaggtgggagccagggctnattttcatagccaagggtcccatgagcttccca

SEQ ID NO: 3098 - DNA, 370 bp, Homo sapiens
  Genbank Accession No. T30214
ggtataaatactttattaaagaaatattgtcattttcgttaaaaaatacattagagaagagagttttgggttaccagtctttcctcacagaatcacagtgtaagatattcatttcttgacgtctctaggaaccttcaggccacggatcagcagaacatacacgaacaagggaaaaaaattcctcttaattttactgatggccccccgtctctcaggtggtctgagagtggcacttggtaaacagtgtgtgtttaatccagcctctgcctctgactacctttaagaccaggactcgaagcagagtgagaggcctccctccacccacctcggggcgagtgaagacacagcttacagaggcgttcaaagtagt

SEQ ID NO: 3099 - DNA, 449 bp, Homo sapiens
  Genbank Accession No. T30222
  unsure (1)..(449): n = a or c or g or t
gagaagcaggacatggaagacatgggaagaagcaaatcataataatgcctttnagtctgaacttggatataaacttcactcgtatccagttactaactctcatcctacttaggaatttccaaattgttaataactttcttagaagcagcctacaatctctatgttgccaccagaatgcttgagttgtttttttcttctgtaaaatcaccttggacccaaccaggacaccaggtccaggaatctgagttgttgagttttacatgatttaagtttgtaatgaaaatttctttcatctagtaaaggtaattactattcaatattattatgtccagaagtgtatatatgctgagtttcattctagctaagaatagaaagtagaataaaaggagactagggttttatttgacctttgacaaggcagtngtccctgatactgagtgactctttag

SEQ ID NO: 3100 - DNA, 293 bp, Homo sapiens
  Genbank Accession No. T30341
gtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaaggttaggagtcaggtgagagtcccttggtgagtcatttgtacatcagtgtcatttcttcttaacctctgaagaagatgggcatcagaaataaagacaaagcacttttc

SEQ ID NO: 3101 - DNA, 169 bp, Homo sapiens
  Genbank Accession No. T32072
  unsure (1)..(169): n = a or c or g or t
gccttactttaatgctgacctagcagccccgacaggaagctttaacataaagccttgaccctgagaagcatgggtgcgtcttgtcgtgagcaggttcatggctgtnctccatcctcagcccgctgatttttggtcttttgtcctttgatccagcagttcccacgtggat

SEQ ID NO: 3102 - DNA, 186 bp, Homo sapiens
  Genbank Accession No. T32108
  unsure (1)..(186): n = a or c or g or t
anctccagtttatttttttaagactaagagcagagtatgaaagtcacagccaaagcacttgaaaaaggcccaggaggataggtgggaccacatagggtgagcagggcaaggtcctgggagatggttcccggctcagggctggaagggagggggcgctgttgttttacggtctccaaaagtgtctgt

SEQ ID NO: 3103 - DNA, 223 bp, Homo sapiens
  Genbank Accession No. T33011
  unsure (1)..(223): n = a or c or g or t
cagaccaaaaaccttctgtttttaggaaaaaagaggaagatttagagacgatggagaggtgaatgaagcacagcacgagcccagctgggcaggggcccttnagggacggctcaacccataggctccgggagggcaggagccagcccctccaggtgggggtgattctntcaagcactgcacatggactcggaagtgagaagaaaagcagagaagagagaggcat

SEQ ID NO: 3104 - DNA, 336 bp, Homo sapiens
  Genbank Accession No. T33489
  unsure (1)..(336): n = a or c or g or t
attttacaacagtaatctttattttaggccaacattcagacatacaagacggagatcaccatgcggaaccagcctggcccttagatgtgtgtgctcgagccaggntcagccggagtctgacagcgcctgcaccccaacacggtcggattccaggacgccagtnacaaaaccagtgcatggacaagcagcttccatgcgtgtgcatttgatttttaaaaacaatacatatttcagtgttaacttcccccctcacctggcttgaaacattttccccattttccagggaaacaaactctaccaaaaggtgccgnctgcaggaccccgggnccagccctt

SEQ ID NO: 3105 - DNA, 321 bp, Homo sapiens
  Genbank Accession No. T33508
acacaaagctttttgagttttatttttttcctcaggttggagattcatcgtaacatgcatgcattttcaaacagtaacagggtctcaaactttttaaagcagacgttagacaagcacaggggattgaaaattcccatttaaaaaatggaaactgcagtgggatatggagaagtcacacacttggtggggtggtggtttgtcctgcttccccaaaaggtggatatgaacttaattcacattttttaatttcagtgatctgacctgatgctgggatgtgccgagcagtactgccccctcccccaagggtgttggctcccaccg

SEQ ID NO: 3106 - DNA, 163 bp, Homo sapiens
  Genbank Accession No. T33619
  unsure (1)..(163): n = a or c or g or t
atacctttttattaattatnaggaataatccattcatgtaatgcaggntgtatgtnggagaaggttaagtacagccacatgaatgaggggaaacgtgcaagaggaacagtggtgagaagggggatggtcccccactttccacaaactataaacagcaacatga

SEQ ID NO: 3107 - DNA, 338 bp, Homo sapiens
  Genbank Accession No. T33625
  unsure (1)..(338): n = a or c or g or t
gctgtgcagtagtatttattgttacagtgttaaaattcacnctcggggaagcgatttggggccacggccctagaaactgcatctttgttcagagccaacccatttcctntgcagccacaaaatgcctttntgtgtcagggctcgggagattctcctcgctggccagccattggcaagaatgccagactcagaggttgccattgcccacaggctttcttctcctttcctttcacagcaggaagagccctccggagcctcgaaaagcagagtggaagtggtggtgcccaggacgnatnggctctnatgggaagagggaggtgggcctgagcatgggcctt

SEQ ID NO: 3108 - DNA, 298 bp, Homo sapiens
  Genbank Accession No. T33859
  unsure (1)..(298): n = a or c or g or t
gcatttcctctacatttattgcaacggntaaatgnttaacaacattcacaacttctnagatcttaaaaaacagaaacaaaagaaaacttccattttgtaacatcacaaatgtnttctaggntttatcaaggnccaaaaacactacaattntntaagtgatttccagtgatggaaacaagccagagacagtaaagcacccagagtggcgagagagcacttccagatgcctgtggtcctctcgggggtgaccctggaactatttgtnggcccgnttgtgtctgtacatctgcatcatcct

SEQ ID NO: 3109 - DNA, 268 bp, Homo sapiens
  Genbank Accession No. T33865
  unsure (1)..(268): n = a or c or g or t
cagataaacagtatgtggtttattcacacaatgaaatattatacaaccatgagaatgaaaatccatgtacaaatacatgcaacaaaaatctcacaaacataatattggtgaaaagaaaccagatacgnagaatgcataattccatttatatatctccccaaaccagacagnnctaatctatgcgcttngaactcaggatagtggtttcccttggngaggtagttaactggaagggnntctgacggggggcttctggggtgccgattgt

SEQ ID NO: 3110 - DNA, 319 bp, Homo sapiens
  Genbank Accession No. T34377
gggagggggtattgggtaggaccatccaagaaagggcagaagaccaagggcagtcggggtctagaaaggagggcgctggccctgctgggcgcttcggagcccccactgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagattcagacc

SEQ ID NO: 3111 - DNA, 151 bp, Homo sapiens
  Genbank Accession No. T35341
accagatgaggaaatggcagttctgagaagtcactggtctagatcccgcaggtggcacatgacagctagggttcaaaacgttctcaccaaatccaatgctcctcacatattaattttataaccagacaaataaatattagagacaaccacc

SEQ ID NO: 3112 - DNA, 282 bp, Homo sapiens
  Genbank Accession No. T35725
aaaatactgtgtaccccctcccccccccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccaaaaaaaa

SEQ ID NO: 3113 - DNA, 241 bp, Homo sapiens
  Genbank Accession No. T39897
tttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaaaaaaaaaaaaa

SEQ ID NO: 3114 - DNA, 153 bp, Homo sapiens
  Genbank Accession No. T40439
cttgtagctgtctcaaggcatttgtggatgagcccagttccttaaatatgacaaaggcctcccccttcatcttcatggtctttaaagccacaatgtccaccacatgaccaaactgagaaaacagggcatatagggatctcttcaatctcgtgc

SEQ ID NO: 3115 - DNA, 347 bp, Homo sapiens
  Genbank Accession No. T40849
tttcgagagatttaaagattttatttttacaaatcacagctgatagacagcgaccgttccccatagagaccgtgctccaactcgggcctgggcactgctcgctgctcccaggaagggggtggcgtgacaggcaggaacctgcgaagtccagagtccagggtggagcgcgccacgctcagccagagcagccacgacagccacagtgtgtgcactcgatgatgcggcccacttccagcttgcttttgggcacgcggcagatgcagttcgtcccgaagttggtgtcccgtgtctgaatgcaccgcagcagcacaagttctcatatccttgctttttccattttgcaatca

SEQ ID NO: 3116 - DNA, 271 bp, Homo sapiens
  Genbank Accession No. T40895
taatggtagctatcaatttattaactggttactgcggcaatatatataattataaaatcaccatcaatcctttcattcatacgttaacacatatcactggtttaattcattgaaggcaaatacaagtttttcccttactttccttccaagattccacttaggctggttaccccaaacgtaatggagaaacattaaatgtcacttttaaaccacttttaaaccagtctttaattttcaattcaggtgtgaggcacatatatacacacaaaca

SEQ ID NO: 3117 - DNA, 337 bp, Homo sapiens
  Genbank Accession No. T40936
  unsure (1)..(337): n = a or c or g or t
tttattcagaattgngngtgtcttattcttaaatttaaaaaagcatcttcagaaggtgccatatccatcccctcgggcagtcactgcaaaagttgggtagacctcataggttgtatatgctgctaagtcttgtccaagggttaccgcttgcttgagctgggctgcagacacgggtgcagttgcattagggacagcatatcctgggaaagcagtagcagcagcagcagcagtagccatggtgccatcgcctccatcagtggggatgcccagggtctgcagggtgtattcggctgcatacgtctttgcttcatccacaaaggcactcagctttggaggt

SEQ ID NO: 3118 - DNA, 343 bp, Homo sapiens
  Genbank Accession No. T40995
taatggttaaggaggaaggtttattggcttcaattccccagttgatgttcaacactttatttagttctcatttggattttaaacatttgcttgacaaataatttcccatcaatttccatttctttggaaagctcccacgtgtaatttatttttaacatctctgaagagcagaattaatgatatttcctagctgttgctccagatcatgtagggtagaggaggctgaaaactgctacaagggaaggcatctgtattgtttcaaaacgtcaggacggtacgggatactctttccagagcgacgagggtcaaatcccttcatttatttttttcaaaagggtaaaac

SEQ ID NO: 3119 - DNA, 312 bp, Homo sapiens
  Genbank Accession No. T41047
  unsure (1)..(312): n = a or c or g or t
tttttcggtagaagaacttttattgaacagtaagattcaagatttcaccagggtnagagggggaattgaaaattagtagaaaaattccaaggggaccagttagccacaacaaagaatggggttcagggaacttcttagggatgtatcttcccctcaatacaggtagaggagcagcatcagaagcagggctttggagagaggcatagaagagaatcaccttctcctggcccacgcaagctacctgggtgtacctntcaagttcagggccagcttcttgttccttccccgctcttggtagatgtaaaaggtttc

SEQ ID NO: 3120 - DNA, 341 bp, Homo sapiens
  Genbank Accession No. T41078
ttttttttttatctttagtttgtaaaagtcttttattgtaaccgtgccacacatagtgaaaaataacactcctaaaaaaagaatgctaccttttccacaacattttattttaaataaaacttcaagtactcttacgtaggtacaaaaaaaatctgatctatttgcctccaacaggccaccacaacacacagtagataaaacacagtggttacaaacgtcttttaaatttatttctgaggcaaggcaaatgggagggaaatgtttctttgaaaaaatactgtgtgcgtaggaaattgtcacatttttattccacatggatacaaatgattatactttaattt

SEQ ID NO: 3121 - DNA, 317 bp, Homo sapiens
  Genbank Accession No. T41232
ttgctcatcagttatcgttagtgtccgtgtattttacgtgtggcccaagacagttcttcttgttccagtgtggcccagggaagccaaaagattggacactcctggaggtgcagcacagtatctaacactacctcaatactttttccaccgaactacgtaagaccagccacagcccagaaaaagaacttcccacaggaaaaggaggaagaggaaaatttggaggaaatctacgaggaggggattggccaaccgcaagtcagcatgggatgctggacacctggccgagcgagaaacagaaacgtgagaatttggaagat

SEQ ID NO: 3122 - DNA, 459 bp, Homo sapiens
  Genbank Accession No. T46901
  unsure (1)..(459): n = a or c or g or t
gctctttatttggggttaaacccatgtggcccagagctgccntgatgacacctccctgaaagcagaagaggctcaggactggcagccgtgggtgcgcatatattccaaaaattcctccagttggtcccgcaattctttcttgctggcatctccatctgctggccaaaggatgaggaacgtctccttgcccagaacatagctgtaatcagatttgattctccacaggtctgacgtctggcccatgatgaggtacgattcctgttcttgcaaccccagggagtcatggcaagtggcatgggagacgaatttcttcatggccaggggtttggcagggtccgtaccactcttaatgatgtcttcgagctgcgtgttntaatagacgtaagggttgggangcagagacctccacaagattcccagctttntcttntacacaaaatccacgcctncctcacatgc

SEQ ID NO: 3123 - DNA, 337 bp, Homo sapiens
  Genbank Accession No. T47032
  unsure (1)..(337): n = a or c or g or t
tatgaaaggtttattccnagngctagaccccaancttcttgggctctaagcacaattaaactgggngggngggngagggtaggcctattcagangcaaggccagcaatggggctccccattatccccacccctttggncccagtccccttntctgcaangggcacgcatagaggagagacaaagggtnttagacgcaacatcattggcccaggggagtccgagaagagctgccattggctgacagggcattttcaggctctgtcattggtcagggagcacaccccagcctgaagngtgatgccattggccaggggagtggttttgtcanagccgttg

SEQ ID NO: 3124 - DNA, 325 bp, Homo sapiens
  Genbank Accession No. T47325
  unsure (1)..(325): n = a or c or g or t
aagaactaannagttttttaataaaatgagcaagtttacatttgtacattttgtgtatctgggacccaatcgggacaaaggataaagttgcaaggacaaaggtttctgtgggagagcaagcaaaaagcaagggctgccccagttgcatcatgggcatccattcagagctgggaccccgcagccacctgcctgtgctccggaagtgagaagcacatgtaagcacgcgtcagtgagagcgtcgcagttgaactcagcccagtgcaacgcagccctgagtgacatccctacattaatacttgatagggaacagcagataaacagttcc

SEQ ID NO: 3125 - DNA, 289 bp, Homo sapiens
  Genbank Accession No. T47601
  unsure (1)..(289): n = a or c or g or t
aatacattttattgtgtatatttgaggtttacaacatggtagtttgggatgcatagaaataataaaatggttactgtagggaagcagatttacatatctatcattctcacacaactactttttgtgacaaaagcagctaaaatctacttagttaacaaaatccctaatacaattttattaaccttagtcctcatgttatacattaactctctacacttgttcattctgcatatctgctatttngtatcctttgacctatatctctgtttcctcctcctgttccctacca

SEQ ID NO: 3126 - DNA, 415 bp, Homo sapiens
  Genbank Accession No. T47778
  unsure (1)..(415): n = a or c or g or t
ttgcttgggatattttaatacatattcaagagaaaatgacaaatatatcttaatagaaaaggatacaaattaaaaatcagaaggcaagaccaccaggattaaagatgcaacttagatcaaatattgaccaaagtaaatgggttganttttgantatagcatagatcatacttagtgagaggctttcgaactaacgacttacatttaataatanttagcatgtcacagattatagtttatgattattaggaaaaatgaagttaaatcaatacttggggagattgtttattaatgtgtgaattatgtctttttttaatattcataaatagttttaaaattttaaatgtgttttaggaaggaattgggttcctcccttggggggcaaanaataggtgtgccattaccacgtctngtgg

SEQ ID NO: 3127 - DNA, 299 bp, Homo sapiens
  Genbank Accession No. T47969
  unsure (1)..(299): n = a or c or g or t
ttttccatggataaaatcggcatttattcagaaggcatgatgcaggaagaaactccccaagtgggagacaatggctggcccccctgcaaggaaacaaggcttcanccttccctactcccagacctgccgggaaggctgggagcacagttcatggagggtctctggggtgggcctgggtntctgacctgtccctntgcccacaggtgaatntgacctgcgtcctnaggatcccgagtatcaggagagctggcagaggaagtcatgnagaggcaaagcagggngccccnacaggagatccc

SEQ ID NO: 3128 - DNA, 526 bp, Homo sapiens
  Genbank Accession No. T48039
  unsure (1)..(526): n = a or c or g or t
gtgcttgttacatgtccctttaatgtcccatccattgcccatgaaaancccagccctgcaggaggggtcgctaaggtcccagctcttctggggggcttcttgtctctgatgtgccccatggatccagtcgaggtagcggctgactttggtgtaaacgccgtagttgtgaaggagcccacagccctcaccccagctcaccaggcccaccaggaaccaggtgccgtggaaggaggcgaccatgggccccccactgtcgcctcgcaggcatcctgcggtccccgaggatgccgacacagcatgttctcagacaccatgttgctcatgacctcgctgcactcattgtcgggaccacgggaatcttgatgaagttgaggacgaaggtgcggtttctcttgggctccttctctcggctgntgtggtagccccagcccgtacgagggtttctgggncggcttattaagcttgcgttttnaaaggccnttttccggagaagatgggaatatggtttcganaggtggcggttgga

SEQ ID NO: 3129 - DNA, 282 bp, Homo sapiens
  Genbank Accession No. T48075
  unsure (1)..(282): n = a or c or g or t
agactttattcaaagaccacgggggtacgggtgcaggaaggggaggaggggctggggggaggccaagnaangaagcatgncaccgaggtccagcttcacggtatttggaggtagcacggtgctcacagaaagcaggaacttgtccagggaggcgtcacccagggtgaactcggcggggaggtgggcgccagggtcaccagcaggcagtggcttaggagcttgaagttgaccgggtccacccaagcttgtgcgcgtnccaggtcntcagggngacangcgttg

SEQ ID NO: 3130 - DNA, 450 bp, Homo sapiens
  Genbank Accession No. T48195
  unsure (1)..(450): n = a or c or g or t
ccagcaggagaatatgcagcgcagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactctttggaagaaatatatttgcatatttgaaaagcacagagggtttctttagtgtccttgccgttttggctattaccatgtcttttcttggccttnattannttanancaaattctttgnnnnnnnnnnnnnnnnnncttcnnggggggggncccgttccccatttggccctttt

SEQ ID NO: 3131 - DNA, 216 bp, Homo sapiens
  Genbank Accession No. T48278
ggaaaacaaaagaaccagccattttattccaagacctatgttctggggcagcaggaataaataaggaagggaggggacgggggcagggaggtaggttctacgtcttgcagcacatcccacactttgatcgatgacagcagccgcagcagaaaatgcagatggggaagtgggtgtctcgcctccttcgcctctggaacatgggcatccagctggccc

SEQ ID NO: 3132 - DNA, 407 bp, Homo sapiens
  Genbank Accession No. T48293
  unsure (1)..(407): n = a or c or g or t
tgtaattttgngnattttttttatttagatactgatgtttattttccatgttgcttaagaacccgtgcaagaacagcttaagaccttccagtggttgctcctacccattcagtggcctgagcagtgggagctgcagaccagtcttctatggcaggctgagtgctccagtcttcagaagggaactgctgaagaggcacagaaggcacctgcatgccttcagatcagtgtgcaacctcaggctgagtagcagtgaactcaggagctggagcagtccattcacactgaaattcctccttggncactgccttttcagtagcagcctgctcttcttttttaatcacttcagggatctctgtagaagtagagttcaggcatgacctcccatggntgttcacgggaaatggngc

SEQ ID NO: 3133 - DNA, 342 bp, Homo sapiens
  Genbank Accession No. T48980
  unsure (1)..(342): n = a or c or g or t
tttttantttaataatttttaagtttaatcnttttaanttttaaaaaaaaacccanttaacaggtacanttttggtctaaaatggtccctctgctgaaagatcatccgagcagtccccagtacagcccccactttttggcagaggtagggtaagggttatgtgcaccctcctcctaccctcaattcatttgtgtcatagagggagaaagttaaaagctcagctttggtttctggcccaagttaggggagcttaggaaaggttagccttgggtccagctttgggcaggaatgagggcccacagatggggacaataagggcacaaccctggggctctgggagga

SEQ ID NO: 3134 - DNA, 351 bp, Homo sapiens
  Genbank Accession No. T49061
  unsure (1)..(351): n = a or c or g or t
ggaccaaagaactttatatttattttaaatatcaaagtaacacaaagaactagttcaatatacagtacacttcctactcttcacagagaactgaaattttctataaagacatttatacttaggaaacatcagacaaccaaagtatgtataaaactcacaagatattttacacacagttcacaataattaattctgatattttaggntttttctgtcattgcttttaaagcatccttaatttaaaaacaaaaattattatttgaggactggaaaacaggtggcaaaggcatttctacttttaattatacactggtaaatccccccttaatccaaaacattttacttncacat

SEQ ID NO: 3135 - DNA, 375 bp, Homo sapiens
  Genbank Accession No. T50773
  unsure (1)..(375): n = a or c or g or t
ttttacccgntngagatctcgctgtgttgcccaggctggtctcgaactcctgggctcaagcatcatcctacctcagcctcctgagtagctgggactacaggcacccgcacaaccacacctggcttttatgaacattttaaccctggtccttntccccacagacaagcctggggacaggctgtgggtcttcttcaagaggctgtctttggattcgaggaaccaggccttggtgcgcggacccaggtccctcaggtggtcgtcatagtaggtctgcatgaagccccggaaggtgctcgggctccagaaccattgccacccgtctctggtcctgttcaccactgtctccagcagctccttcatcctgcccctcaccag

SEQ ID NO: 3136 - DNA, 409 bp, Homo sapiens
  Genbank Accession No. T51150
  unsure (1)..(409): n = a or c or g or t
taatggagagggggatgtttaatgagttccgagcttcagtttgggaagatgaaaattctgaaggtagatattggtagtggttgcagaataacatgcattacttattgttacttaatgccacagaaacctatgcttcaaaatagttaaaacagtacattttatgtctattttatgacaacttttttaaagggaggcaaatcatacaatgggggtgaaagcagttaggcccttgtactaagttttgggaacaatgtaactcaatgttctcacaccctttagagaggagctcagagacatgaagtaaccctatccgtccgggaacctacattttctttgcatcccagtgggggctccctctccctgaaagtcccatgtgttcacagtttnacaaggttttacctggggaatg

SEQ ID NO: 3137 - DNA, 469 bp, Homo sapiens
  Genbank Accession No. T51617
  unsure (1)..(469): n = a or c or g or t
gaatacaaataatctatttgtcaatgaaataaacacagctctttgaggatttgagactacattcaccctttattcacagtcacttgcagttttgcttttctctgcatttctctgctgtaagatgactgttgcattgttaaattgtattttgaatggatatttttgtttggtaacaatattttaaatggtaaaacgtgtgcctttgtcctttctcttccttctaaacatgtatctctcccacaggtcattctcctgtcaccgtgtgtactgcagactgtttcaaaaccgggcaggcaattaggcaatggggaaataaggtgggtcccacccttcaatatttgcttggttggttccatttaccatgcctcttgggnacccaatccctaggactcacggtggtgcccccaggaataaccattcaggactctcaggttgggggcttggtggtttaccaccatcccngggggcc

SEQ ID NO: 3138 - DNA, 444 bp, Homo sapiens
  Genbank Accession No. T51930
ctgtcgcccaggctggagtacaatggcgtgatctcagctcactgcaacctccacctccccggttcaagcgattctcctgcctcagcctcctgggtagctgggattacaggcgcgtgcaccacgcccggcatgagtggaattttagtgttaaatctcttcctgactctgggttcagtaggtccctcctcttctgttaccctcctggttctctctgttcaccaactacctgcatgtgccaaactagaaaaaggaaataatttacacccctgccccaacagctccttccctcctagggacttctgtgtccaccccccactttgggtcttagaactgtggctagaagataaaagggaggagtttgagtcagaggctttatgtccccaaacccaaccccctctgagtattaaactatagtgggcattgtccctcaagctcccctctgcc

SEQ ID NO: 3139 - DNA, 430 bp, Homo sapiens
  Genbank Accession No. T51972
  unsure (1)..(430): n = a or c or g or t
tcattttcttntttttatttgtcaatataaaaatactcaaatatttacaacaaataaatacgcggggacacaataagttacactgttaggagccctcctcctagggctggaagagagtatgccattgtccacagcaggcccaccctctcccttctctcccctcacacagcctttcccagccctgtacaggaagaaggcaagtataaaataccactgaaccccggggccaagtgggaggccccacccacccttccccccaaacacacaggaggctccatctccctccccccaccctgaaaacattcacagccctaggagcaggantaggcccaccccaagccctgcantccctntgaaggggcacagcaccctgtccaccccacctccntatgtacatcgttgcccgacattcgggggcagtggggggtag

SEQ ID NO: 3140 - DNA, 435 bp, Homo sapiens
  Genbank Accession No. T52564
  unsure (1)..(435): n = a or c or g or t
ccagtanctnnacataagggaaattaatcagttaatttctgctgacttaggtttcctaaacagcttttagttctcaaggcacagctgtggtaaaaacagagcaaaacacccagccatttattggaattctgcagtacaaaataagcacatgtctctatataatctagtaacaggatagcaacagttaaactgtctcaaacaacagatgtatttgcttgattttccttcctaacttcttttgcatcaggaccgcaagcaaagagcttgtttcccagagtattttggggcaaatcgggaaatacataatgtgggcccattgccacaaaagggaggactggaaatcaatacggaggcaaggcccaaaaggcttcagggatttgggagccggggggtggcccatggatggaaatgccgggaggntccagggaggntagg

SEQ ID NO: 3141 - DNA, 391 bp, Homo sapiens
  Genbank Accession No. T52813
  unsure (1)..(391): n = a or c or g or t
ttggtatanaagttttttatttcaaaatgcaaaatggtggtcattgtaataattaataataataacataaaaagcatttatccttcctccctagtgcaaaatggtagacgcatttagataattcacacagtgttggaaatgtcatgacaatgcagtgctgcacagagagatactcaatcccaaactcctttggtggatgcttgtggtaggtcagttctagatgtcagcggtttctctgaagttaagtccaaataaaaaacagcacgtgctcctgcactctcccagcggagtcaggctcctgtgcgcgcgccccctctggtctctcccttccttctcggtctgtctctgtctactgcgtntccctcccactccgctggtctcccacagttcc

SEQ ID NO: 3142 - DNA, 404 bp, Homo sapiens
  Genbank Accession No. T53404
ctgtagcaatgaaaatttttaatttgaataaaaatcacgtaagcatgaggttgttggggaacacggaaaggaagggctcagattagggggtgtagcacatttatcaggaggtaagatctccatagtctcctacccctcctggcctggccttttactgtggtatccagcctctgggaagaccttgtatggacagtatctccactggggctatcactaggtgaccaggtaggggacagagtagagcagccaatgaccttaactcaaaatcttttctctcccttcaacctgtgaaaaaagatgactgggcacatactcagatgtcccctgggcatagcaccatcttgttggccagtcacaaacaccagctcttagttaagagggcctgggtttaaactcgtgccgat

SEQ ID NO: 3143 - DNA, 309 bp, Homo sapiens
  Genbank Accession No. T53590
  unsure (1)..(309): n = a or c or g or t
ttnggtatgtggttcagctntttattntctccatggggtgggtgaagaggagtggcccagctgagctgaggaaggtgaccactgagaacccattcaacctgctgagcagcttgggcagaaaggagcaggacttgggacagacgactgaagatgcagagaccccatgggccccacccctgggccttcctcccatntggctgcaggcatcctntntnatcantgctgggttgcttcctggttaaagggccanaaggtnaaggagatgggnttttcangcatcagaatgaggttnaatttggtgcccacatc

SEQ ID NO: 3144 - DNA, 163 bp, Homo sapiens
  Genbank Accession No. T54160
acaaattgcagtttattaaggctccagagtgagaaatggcacttggttctgggcaggggcaggggcaggggtgtcagtggaacccaaaggagctgggtccaaacatgttggagggacctcctccatccccctacccccaataaataaagtctcagctccatct

SEQ ID NO: 3145 - DNA, 315 bp, Homo sapiens
  Genbank Accession No. T55004
  unsure (1)..(315): n = a or c or g or t
tttatatttttattctttatttttaaaatttatgtatgttcgtgaggcacaagtgcaattctgctacattgatatcttgcttctcagtcccacacaaggaagctgtctcacactatagaganaatattcatgaacaaattcgtatcagtcacagtgagaggtaacactctaaatagcccatttcatgctcaagacatccaagtcaaagaaacccaatagcacagctgagtcccctctgttccccccccaacaccccactcacatcagggcccctgcctgggaggtgtcacctttattagctgtgaggagacaccc

SEQ ID NO: 3146 - DNA, 395 bp, Homo sapiens
  Genbank Accession No. T55196
  unsure (1)..(395): n = a or c or g or t
tatnnccagtcaaataaacccttctttattcgtacatagctgcagtactagattggaattcacttcacaaagagaaaaatacaagccaataaatacttgagaactacgtgatcttacatctcagagagtgtgggctggagaggcctggtacactggagaggtctactacactggagatgcccactacactggagacgcccactacgctggagacgcccactacactggggtctggtggccggcgagtgaggggacctgtctcacatgggtgagggtctgcagcacacacaatacccagatgttaccaagggcacaggcagatggcataattgggtgaggaaatcaggaaacagggacacaagtttacaggagggaaagaaaaagaggctggggcc

SEQ ID NO: 3147 - DNA, 375 bp, Homo sapiens
  Genbank Accession No. T55547
  unsure (1)..(375): n = a or c or g or t
tttttattggatttaaatattttatttaaagaaatattcttaaggctgcagtttattgataagaaaaatataaagcatacatgtttatagattatgtattgacattatagtatatagattctccaaataacataattaattttgtagtgctactagtggaatgcattctgcagaaacatggctttaccttcaaatctaagcacaatacccttacatcaaaaatgaaggataataaaagcacaactttgactcatttaaattttgggaggccacatctggatttgttggagggggtaaattcggtttatttccctcttcaggggaggncattattttttgccatctctttcnggggcccccttttatccctnttaa

SEQ ID NO: 3148 - DNA, 370 bp, Homo sapiens
  Genbank Accession No. T56264
  unsure (1)..(370): n = a or c or g or t
ttganttnngntttttattgaaaaganttcaggctaganttgggaggaggatgcaagagctactgggaagggggagctcagtctgaacctgggggntcaggggantaggggantntccccttntccactgatgggggntntggctnttactcctctcccttcagcacagaaagaacttggtcagtaaaaatgcctntntaagtgctcatggctgctgtgcttttgctgtacaagtccctgagtttctcatctacagcgggcaggtatgtcttctcgtacaggttctgggcggctgtctttgctgactcccagtaactgggagagagattccttcacctgggttaagggaaggntcgggctaangcaactc

SEQ ID NO: 3149 - DNA, 306 bp, Homo sapiens
  Genbank Accession No. T56279
  unsure (1)..(306): n = a or c or g or t
caaaactttatttatgantaaaaatgaggtaaaacagtanttgaaaaatgaanttgaaaacaaatataatagtaaattcagaaaaaggtntgcattttactaatagtaatgccattgattctatttttcttcacaactgggatataccagtttcccattctgacacattgctcgaaatgaatgagattttgttggatgatatccagatttacaaacaaattcaactatggtcacctgttcttgaataaagcttttgttgggtttgtccactttaattttatggtnatatttttccataatttctgg

SEQ ID NO: 3150 - DNA, 470 bp, Homo sapiens
  Genbank Accession No. T56281
  unsure (1)..(470): n = a or c or g or t
caggtntatnttntttaattatcactcacatatttcacaggaaaaggantntagcaaatgggtcaaggtggtntaaaaaaaaaatccaggtttntacatgtctctctgtttacatctgggagaaaggttntcctggcatcagtcgcagcagctgcacttctctgacgcccctttgcaaacacagccctgggcacacttgctacagcccacggggaggcaggagcagcagctnttnttgcaggagggtgcatttgcnctctttgcacttgcagggaaccagcgcagggtgcagggagacaccagcgggcgcagggagcagttggggggncccattgcaagcccgagggagagactgggacttttcccaaggagagaagcgaaggaagccagtggggggcagctcgtgcccganttccttcagccccggggggntccccctagttctaggagcggnccccaccgggtgggat

SEQ ID NO: 3151 - DNA, 447 bp, Homo sapiens
  Genbank Accession No. T57140
  unsure (1)..(447): n = a or c or g or t
agatattgatatacttcctagtgggctggcttttatctccagtggattaaaatatccaggcatgccaaactttgcgccagatgaaccaggaaaaatcttcttgatggatctgaatgaacaaaacccaagggcacaagcgctagaaatcagtggtggatttgacaaagaattatttaatccacatggggatcagtattttcatcgacaaagacaatactgtgtatctttatgttgtgaatcatccccacatggaagtccactgtgggaggatattttaaattttgagggaacaacaacgttcttctgggtattacctggaaaactattaaaacatggaacttcttcaaaagtgttgaattgacnttgtgggttcttgggaccnggaacatttttttggccaccagagaccanttttttacccaantccctcccgttcnttttttgagg

SEQ ID NO: 3152 - DNA, 286 bp, Homo sapiens
  Genbank Accession No. T58032
  unsure (1)..(286): n = a or c or g or t
tttttgcgttngntcaggaagcctttattgagggccttcttggtgtggaagtgctgcactgagtctgcagggacagaggaatgggcaggagcggggccgggggtagaccacctggcaagactggcaaggcagtgggctgagtctgccagagaagatggggagctgctgcccgcccagggcatnggcatctgggctgagaagggcaggagggtgggtgacaacaatgtgcaggtctntgggggacacagcggcagtacacagagaggtagtgggggctgggagagtt

SEQ ID NO: 3153 - DNA, 429 bp, Homo sapiens
  Genbank Accession No. T58153
  unsure (1)..(429): n = a or c or g or t
ttttagaaagggacaccataagatgaactttattttaaagctcataaaagtgttcacannnaaaaacaacaggatcgacatttcttccattccacactttcacatgacaatatactgtatagtgagagaganagtttanagtttttgttctgcatgctgctaacacatttgactagcttttgttttactcattgaatttttaatatcaaagcaaaaagtcattttctcttggacagaaatggttttagaaagcccttatgaagtcagacttagtcttgtttataaacatccacacccncacacatgctggaatgggngagcaaaatgcaaggcaactaccttgggcaggggaccaaatgcttaaaggatttgtaatcacagccctcttgggcaggcnggtaccggttttttttctcccnaagggccaaa

SEQ ID NO: 3154 - DNA, 235 bp, Homo sapiens
  Genbank Accession No. T58607
  unsure (1)..(235): n = a or c or g or t
ttttcagtatcttaaataaactgtttattcagaaggaacaattaaagaaagcaactatgatatggattacaaaaacaaacaagcatagatcctctccaggctccagggtgagacggccccacgctgcaaagactgccagccctgggggatcgcatcagtgggctagcatgtgtgtgtgagcgccgacacgtgcnacacacaagcacacacacgcacacccgccacccacagggtt

SEQ ID NO: 3155 - DNA, 441 bp, Homo sapiens
  Genbank Accession No. T58756
  unsure (1)..(441): n = a or c or g or t
gattcaagatttcaccaggngagagggggaattgaaaattagtagaaaaattccaaggggaccagttagccacaacaaagaatggggttcagggaacttcttagggatgtatcttcccctcaatacaggtagaggagcagcatcagaagcagggcnttggagagaggcatagaagagantcaccttctcctggcccacgcaagctacctggtgtaccttcaagttcaggccagctgctgttcctgcccgctcttggagatgaaaaggtttcccatgcccccacctcctcccgagttaattctctccagggtgcttctctttgatgtaaacccaggggtgctattagcaggctccttgttctcttgctcaaatcctttccaacctttccaacctgtnggagctctgctgtttctaatttcttaacccccatcttgtttcttt

SEQ ID NO: 3156 - DNA, 306 bp, Homo sapiens
  Genbank Accession No. T58775
  unsure (1)..(306): n = a or c or g or t
gtcaaactcatggagttttatttattgcatgcttgggttttggactaagagtttacccctagccgtgtctcataccctttctttccctgtcctgcaaagcttaacatgggaggtagagatttgtgtctcttcttcttcttcttctctctctctctcttttttttttttttccaatcaggcactctctgtacccctgccaccctgaggaagacaaaatatgagaggatctagcaaagtctctgcaaaaatgattaatgtgaatattcccatccggacttccnatgaaaaagttgcattataaaatga

SEQ ID NO: 3157 - DNA, 337 bp, Homo sapiens
  Genbank Accession No. T59148
  unsure (1)..(337): n = a or c or g or t
nattaaatctatatttaatttnatcaagttttnagagtattctgccctgtnaaagngtcctgagtttgcagatagtgttttaaaaatagagtatcttaaagtatagaaagagtccagaaaatagaacagcaacttttcctaccttgancaccattaatcagcaccataaaaagtaaaaagctacacataagcacataggcaagcctagtccaccaaaaatacagtattagtaaatggatgaaatctcatgaagagtancttagggaaggnctgtaaggttttgaaggaaggtgactgacaatttaattgcaaaaggacacaggattattagggcata

SEQ ID NO: 3158 - DNA, 446 bp, Homo sapiens
  Genbank Accession No. T59161
  unsure (1)..(446): n = a or c or g or t
ggtgtgttttattttcattattcatacaaataattttctataatancccggggcaaacccgagaatttggcagnccgattgggggggggncccttcagagacccacaggccggtggantcggcgcggagnccagggntcacagtgcagcttgtggctcgtgtccatcttgcaggtggctcttcctccacatcacgactggggtctcgaagggacgggggtaggaaatcctccaggatcttaggaaatttcactccgcttctcctgctcaatggnctctttgggtcggcaggggtgttcttctcctgcgtctccgttttcttcagcttggccttatcgaagctgggcgatttcccccatgtctgggtttgtctgccantttcttaaaacaatccgngcagtctcgttccgagcccgagatccgggggngctcccactcgcctcgtgc

SEQ ID NO: 3159 - DNA, 497 bp, Homo sapiens
  Genbank Accession No. T59668
  unsure (1)..(497): n = a or c or g or t
tttttccattatcctggttttatttaggaataggatgggggtggggagggcttaagtggcccacacgtccaggtntagactgactacattgagtatcgctccaacaccgaacttccctttaacggtttaaaaaaagggtcatgagtntcaacacagttcagcagtgttttcatgggagaccttcaggcaggcaggaggacatcctcctctctgctcaggaccaccacgggagttctaggcactccacctcactgttcttcagacagctgtgatgtgagcaggggctaggccggtaatcaagggggccagactgagccatgccacacccttcctcctagtccccatgctctcctgggggagcctggggcagctctgctttactttcccgttttgtgttttttcttttgttccttacgttgctgtgctctttgggtccttctttcatccttgagtccaccaccttgaaatgacctntgacttcagctnggccggcgcac

SEQ ID NO: 3160 - DNA, 587 bp, Homo sapiens
  Genbank Accession No. T60407
  unsure (1)..(587): n = a or c or g or t
ttcagaatcagatatgtttaatatctgcatataacttaatatgcatttcttccattacaatttttaagtataatccaaggctttaaaaggtatcttttttttacagtaatttaaaattatagaagatgcctttcctataattgaagttattgatcaattgaaggtataaccagactgaaatatacagcaacttcttgaagaatggcaaaaataaagtgaaagttctaaattcttctctgaatttttcagctattgctaatggaaggtgctgccaatataataggcaacacaggttcgtctaacacaggtcggtctaacactggtccnngtaatcaatcatcatatcttatttctttcctttttcttttttgtttttttgagacggagccggcntctggtcgcccagggctgggagtgcagtgggcgtggatctcgggctcactggcaagctctgcctccnggggnccacaccattntcctgcctcaggcctcccgggggggctggggnctacaggggggcccgncaccatggntcggntaaattttttttggatttttaggaggggcaggggtttcaccgtgttagg

SEQ ID NO: 3161 - DNA, 344 bp, Homo sapiens
  Genbank Accession No. T61256
  unsure (1)..(344): n = a or c or g or t
ggctctgcatcccccagccatccccccagagcctctccctgtgggaacacaggacacaggcagagtcctccccacagcttgcatctgtcccctgaacagggcaacctggacgccaggctggatggaggggagaaggcgatgcagccgcaatggtagtctccatggtttgtgaggagccggcacctgctctcacacgatgccatcaaagccctgcaggccacacttcttgccggccacctgggaacccgaatctcagtgcttccctgcacgctcctcccctggganaaggctgaagaatgacggaggcatttnaaggtttctccangctcccagtntaatccacc

SEQ ID NO: 3162 - DNA, 337 bp, Homo sapiens
  Genbank Accession No. T61373
  unsure (1)..(337): n = a or c or g or t
cggggctaaggggctttattnggctgggggaaggagatgggaggagggagctacagagggcccggcatgtgggctctgactcctacagatggccaggagctgggcagcccaccagtactgagcgatggagcgtgggtagggagggtccacagtntccactcgccgtntgcaagattgactcggtagtacttgtctccagagaagaagaagacactctggatgggttcacaggtggcaggcacaagcagtccatcctgtagtcatcatagttnttggctcccaagttgctctcctcactggagaacaaggacagccacgtggcgccgggatggccggc

SEQ ID NO: 3163 - DNA, 548 bp, Homo sapiens
  Genbank Accession No. T61389
  unsure (1)..(548): n = a or c or g or t
tggggcagananaagnnctttattgatnnnntcagnaatgcagggctggcacccatcagcttcaaaccacatcttatcgcatccactcctntccncttccnnncccattttgccctntttcagggtgaaatcttgctttcaggcaagggcttccggccagccttgcattagttctcagctatggtcttctgaacccagtcctgggatggaagtcaccttcacatacacaccatactcagccacagcacagctcttatcaaagcttaagatcccagtcgcataccagggtgtcctcctccaggggtcgtggaacgggcaaagggcactgcccgcatcgccataggcagggtgtctttcttgggtactttaggacatggccaggcacaggagggtgtgtttcatttcagtatgggggcttgcacccctacangggctctttcgggtgttcttctttttcgggggacttgttgctggcctttcataatgncttatggatttgggttttgggtcaggcacagganggcattgacatacttcagatggggnca

SEQ ID NO: 3164 - DNA, 124 bp, Homo sapiens
  Genbank Accession No. T61649
  unsure (1)..(124): n = a or c or g or t
gatttctcaacatcaaagtttaattattacaaaatatgttcaagcaacagatagaatttcaaaaacagtatttgctttncttccttgttttgctccaacactaatcatgctgaggtttttgaag

SEQ ID NO: 3165 - DNA, 116 bp, Homo sapiens
  Genbank Accession No. T61654
  unsure (1)..(116): n = a or c or g or t
ggctttgggganggtcctcgagcgcgggcttggcttctcgctgaggtgctagaatgctcggtggccttgggtggtactcggccagtctgggccgcgttctccttgagagcctcaag

SEQ ID NO: 3166 - DNA, 504 bp, Homo sapiens
  Genbank Accession No. T61801
  unsure (1)..(504): n = a or c or g or t
aagtgaanttgcaatctgtctttattatgagaaactggggaggtgggncaggcagactcatgtcagaagnccctcagtgagaagcaagaagcaatctgtctttattatgaggactaggaggtgggccaggcagactcatgtcagaaggccctcagtgagtgcagcccaggagactggtcacattctggggttgcggaagggccttgntgcattcagtttctccacatcactntagcagtacaaattgggccatggatgaggtacaagccgggaccattggcggaacatgagttagggccaaggncttttccatacacaaggctccgtctaccttctcatggggnccaaggaagctctntccacgtggcttggntcctgacttcaggtccagccaccacagcagccgtcctnccatgatatngagccgagaagaccagggcagataaaggccgcattcacagagtcaggntaattccatgangggtccancttcttttccagcgt

SEQ ID NO: 3167 - DNA, 595 bp, Homo sapiens
  Genbank Accession No. T62521
  unsure (1)..(595): n = a or c or g or t
aacttaggtgctcttttgcgctatatactttaattcatgcaaaagtgatagaggactggacnttgaggctctacagaggcctttctgagaaagctgtgtagctccttactctggcgaagaacaagggggtgtacatcttgtcaatctcaaaagcactgactgcagtctcaccagttgatttgtaagtaatgtgacaagaatgatgtatccagatgagtttgttgaacctctggtgaccactggaacatagctgtagccccacatgaaaactctgatctgcttcttgtacagggacacgacgaaaatatctgtatttatagtcaagtgggtttttcttcttttttcttagttattacagcaaatactttgggtctgattgtctgtgtcttgtgacaagcgatagtgacccagtaggaattgcatcagtcctgggggattccnaggttcttaaacgtggggaccaatgggactgagggctcttcagggggnttgtccaccatccatcacatgggcccatccggggaaggatccttattgtnccccatgtnattagggnaaggggaggccccaaaccacaccccccncaccanggttt

SEQ ID NO: 3168 - DNA, 237 bp, Homo sapiens
  Genbank Accession No. T62918
  unsure (1)..(237): n = a or c or g or t
tttttttaagaatcttctgggcctctttattaagagccctctgccttnccaggggagggaagcaaatccttcagggcccccagagttcctgcaccccatatcatgggtgagnctaccagccacagagccacccgtcaccgtggagaggcttaagntgcactcagagctccccccgggcatgccgaatgtagtgttgatgcagccctgcttcctgagcaaagtcctgaccgcactctg

SEQ ID NO: 3169 - DNA, 554 bp, Homo sapiens
  Genbank Accession No. T63364
  unsure (1)..(554): n = a or c or g or t
aagggcanaaatgattttatttttaaatgtggacaggcaagcagaggtggttggcaaagnaaggtggctgacgatccggaanctgtacaggagagataagggcactggctgcagagtccctatcgaagcatcatccgaaccctgcggtaggggtggcccacaccacggcctgagccaagtcaatgccatatttntgggcggccctcangacactgcatagcgaccattgagatttgatcggtaacaggatgcataccaccaggnaccntggacaatcactgcacagttgctgttgcttgantcgtggtcagcgtcataggtggtaaagggcctcccactgtggagnctcagggaatcccctgcagtncctctgagaacttgcccagtgccagatggtagtggtctacctcaccgaggaggcggaaggtcgcatagtgggcgaaagtacggttaccattaaagtcttccagctctacccgcagcttccagttaccctggagantaagctggtcaaattctcatttcccagccagaattcagctnttggttccaaa

SEQ ID NO: 3170 - DNA, 426 bp, Homo sapiens
  Genbank Accession No. T63490
  unsure (1)..(426): n = a or c or g or t
gagattcacagttattatttacaaagaaaccataaaattgtaagtaggtgaattcatccacatactatttcagtgagtatttttgcttaagatcataccaaagttgttcgtttctttgttacgaaaaanttatttgcactgaaaaaaatatgttcatgctgtcttccttgcattcctactctcaaaattccattctcttttaaatgtcatcctcttccttatcttacttgganttccaggtggtatatctggcagttacacacaaacagattacttttatgtggcttagtaaaggtgtaatagagtactaaaactaagtctataagagantttccatactcaagtacagcccagattccataatgctagagcaaaaagcacatgagtgggaaagtcaacagggactcaatgggccacataaaggcc

SEQ ID NO: 3171 - DNA, 306 bp, Homo sapiens
  Genbank Accession No. T64575
  unsure (1)..(306): n = a or c or g or t
ttttttttttcagttttnaagggttatttattaaaccccttggttctgaccccaagctgagtgggactcagattcagaccctgcactcagagagccccctgacttggggaagacagagcagagaaaggcagccccantntggccaggntcagctggaaggaaggacaaggggntgggagaacccaganttcaagagntctgggaaacagggaacggcnttccagacggagggcacaccttgggcatgggtaaggaaagcccatcgttttttntaggaagcatggatggatgaaacggggtcccagc

SEQ ID NO: 3172 - DNA, 421 bp, Homo sapiens
  Genbank Accession No. T64887
  unsure (1)..(421): n = a or c or g or t
ttngtaggtccgataatgacttttattttaacatatttaattacagacataaaatagcttggggaggggggtgagcccagccttagccccaccatgggtattaggangggaggcgcagnggggccccctgctgaccctctntctgggggtnttcctatggcggggcctattgcttgantgggggaggagccatgcaaatgaggggggcagggcagccactcggccccaccccaccccgaggacggcctccccacagantgcccaggctntgccccagccccagntnntccacctccttcctntntttccagggagcagaccctttggccagcccctgattttgcccntaccccntttgcaaacctaaaggggattaaatacaaattttacaaagtaaaagggggtccaanattgccctggg

SEQ ID NO: 3173 - DNA, 422 bp, Homo sapiens
  Genbank Accession No. T64933
  unsure (1)..(422): n = a or c or g or t
taaanntgatttaaaaattactcttttacttttattacaataaataattatcaataataganttaaacaatttcaattaaaacctactgcatnctttggggtttacagcagcagancaaacataaatccagttgaaagggaaggcttccagantccagtgacangaacagtctggtcttgattattcgggcnagcaatgggaaacactgatacagataatgcaaaaacaatgaaatgcatcggcatactctctttgtacatcacattatctgacactttaaaatattccagctangtaatttaggcaggccatgaggctctgtttctgcacagtnggggttctcccccagcaggcccacagcacactgctcccngggccacccttgggccngaacggggcccatcatcangcggcctggagg

SEQ ID NO: 3174 - DNA, 319 bp, Homo sapiens
  Genbank Accession No. T65443
  unsure (1)..(319): n = a or c or g or t
ctctaaatttattagggagtttgttacaaatntnccggctttacaggcatgatttcacggattcaaacaagaaattaacactgatatttagccttctcatgacatacacagaaataacattgctacaaactgcaatggngagantcttgtttcaaatggcttagtttggggttttgtctaaatgtatcattatataatgaaagcaccnatttgagggtttctcaaatagtgatttgaattttaggacataacagtataacatgggtaactttattcttcatatataantaaggcatantcgggangtgtattaatgctg

SEQ ID NO: 3175 - DNA, 550 bp, Homo sapiens
  Genbank Accession No. T65957
  unsure (1)..(550): n = a or c or g or t
tagcaccgncacaaatagcactttttatttccactatttgaagtctgaactttaaacagattcttgactggtggtcatatccatcagctcgtcaacttagacctgtctcgtcccagtggcttttcagaactactgccttaccatgaagctccatgagtttccaattcaaacttgggcttcttcagcatttttacttttctaacgagacatcatggagaggataaatagattggcaagccttttctatgtcttttccaatgctgtctggaatcaatttattgaccacttctttcaagtcatttgtctgcacctctcgggcatgatttccatcatcttcttccggattggcgggacctgttggngctgagcataagagggcttccgtatctgattgttgcgttttttaggtaaanccaacacaggacagacggaggcaagtaaccatcgggaggtcttgacaacaacggnaggcttcaatcaatggnctgccatttttttgaccatggnccacattttgtcacggggtaggancctggccatggaggttggt

SEQ ID NO: 3176 - DNA, 554 bp, Homo sapiens
  Genbank Accession No. T65972
  unsure (1)..(554): n = a or c or g or t
ttgagacgganttcactcttgttgcccaggntggagtgcaatggcaaatctcgactcactgcagcctctncntcctgggttgaagtgattctcctgcctcagcctcctgagtagctgggattacaggcatgcgcaccacgcccagctaattttatatttctagtagagacggggtttttccatgttggtctggctggtctcgaactcctaacctcaggtgatccacctgcctcggccttccaaagtgctgggattacaggtgtgagccactgtgcccagccctttttaatttttttttaattggggcagtcccagaagcagattagtttcagaggggactccccatttcattttttgtttgctgcttattcctctataccaggggggtattcaatcttttgggcttctctggggccacgntgggaaggaattgtccggggggccacacataaaatacactaacgataactgatgagctttaaaaaaaaaatcacacacaaaaaatctcatgttttaaggaaagtttacaaatttgtgtttggggctcattcaaa

SEQ ID NO: 3177 - DNA, 570 bp, Homo sapiens
  Genbank Accession No. T66189
  unsure (1)..(570): n = a or c or g or t
tcttttttcagatgtgcaggtntttatttcctctccctcactctgctcnaacacccagcataaggcactacccccagatgggagggaagggagggcnactgtgaactcaagtntgagggggtcatctgcannaagaccggagttgcttccatgtcactctcctctcaagagaagctgctatttcagggtaaatggagtctgctctcatccatggttaaaagtggattgagacgntctacagaganttccatcttctttttaaggaacacatccgaacganttcagaagggaaattttgatatttaaaantcagtgtctctcacttcccactccatccnccacctccctttntaagctcagagcacagcgttcctacggtccagccagggaatctttccagaaaggggnttgagagtttcgggcccctgatgggagcggctcatttgctggccgtgaacgctgggtttcccgtgatagctctcccaaggttcagggcgtgattgtcatgtgtaccttcgaggnttttnacggnctcagggtcatggcgtncggttcacgtgatattcgtag

SEQ ID NO: 3178 - DNA, 404 bp, Homo sapiens
  Genbank Accession No. T66935
tttctaattgagcaactttattcacataatttctacaccaagaactcgaggttatctctgatggaaccaatttcactaatatttactttaagggcagagaagtcaaccaagtcctcacagtctcaagaatcaaaaacaaaacaaaaatacaaacagagagcaagtgggaagataaataacactccgaaataacctagctacacacttttagtttccaatttttctagcatgaaatcacttttctcttccatcctgtaagacgtgttctctcctctctcttctgagttgggctgtgaagagctgccctgggtctcccgggtctgacgggtgttgtccaccccatctgagggcacccaggggaattgccctgggggtccggagccctgggggtttctggatagcct

SEQ ID NO: 3179 - DNA, 445 bp, Homo sapiens
  Genbank Accession No. T67053
  unsure (1)..(445): n = a or c or g or t
ttctggttgtcaatgaggatatttattggggtttcatgagtgcagggagaagggctggatgacttgggatggggagagagacccctcccctgggatccctgcagctccagggtnccgtgggtngggttagagttgggaacctatgaacattctntaggggccactntcttctccacggtgctcccttcatgcgtgacctggcanctntagcttctgtgggacttccactgctcgggcgtcaggctcaggtagctgctggccgcgtacttnttgttgctctgtttggagggtttggtggtctccactcccnccttnacggggctgccatctgccttccagggcactntcacagctcccgggtagaagtcactgatcagacacactagtgtggccttgttggcttggagctcctcagagganggcgggaacagagttacagtgggga

SEQ ID NO: 3180 - DNA, 460 bp, Homo sapiens
  Genbank Accession No. T67231
tcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagcctcactcttcatggtcactggggccttggacaagttgttactgactatgttcatggggatgccttgcagaaagctgccaaggcagggcttttggcactttcagctttaacctttgctgggctttgctatttcaactatcacgatgtggggcatctgcaaagctgttgccatgctgtgggaagctctgacctttttgacttcatactttgaaggaattgaatgtatgcctcttttgcctctgctttgtcatgccattaaagctcacaataat

SEQ ID NO: 3181 - DNA, 537 bp, Homo sapiens
  Genbank Accession No. T67520
  unsure (1)..(537): n = a or c or g or t
acattttatttataacaggaaaaatatatccctctatattttagtttaaaaaaatactgcttggaagcagcccatatcctgtgcgttttgtgaattttcaggtgagactccctcaacccgctttcccccctcactgccacaccactgctagtccatggggagggggctggggttcaggtgggacctcttggttgggagcctccattgctactttgcatttaaaggaccgagagtctcctcaagacaagaccactgttatgtgatggatggggggtgtctgttgctggatccagttccaaaaggtgcccagggaacctggggaaggtgactaccctatcatctcacagggactccccacactgggaaccccagcctcctggggtcctgggtccaggggctcttttcccctgggctgggtccatgggttgcgacacccacggcacccgggcattccacgntggtncttcgaggggagggcttnagagggctaagctncaccttctntttccctggggtngccagattcantccttncct

SEQ ID NO: 3182 - DNA, 600 bp, Homo sapiens
  Genbank Accession No. T67705
  unsure (1)..(600): n = a or c or g or t
agcatatatttcttctttcctacgccattgaagaggctgacgattataataattacaatgaattacagaaggaggtgggatctcagtcctccagggtcagggactcttaaactacctcctttctctctttgctcagctcttccccatacccctgtctcagtgtttcttcctttcctcaaaatcctcaacagagaagccagagctgggcaggtgtggggtatgggttagccagaggtgtgctggggtcaggccacctcgccggtcgatttccgccttttctcacacacccagcggtacacctgcaggcagaagtcatcgttccagcggccatccggctgggactttcaacacagtctttcactttccacccagctcgtgcccgtgccaattatctgggctnaggtgacagnccagttcttgtangtttgtggcctataggtctgntggccattccacccattttnccaggggccatnattgtnccgtggntcggtgnccgaatttccttgcaagncccggggggantccatangttttaggnggcggggccgcaccgggtggggaagcttccagnttttngtttcctttangtgaggggtt

SEQ ID NO: 3183 - DNA, 571 bp, Homo sapiens
  Genbank Accession No. T67931
  unsure (1)..(571): n = a or c or g or t
ggntagtttcaaactcctaggctcaagctatcancccactttggcctcccaaggtgctggaattacaggtatgagccaccacacctggccttgtttcctggcattttacggtatccaaataattacagatcaacaggtcaacaactgtcgaaagcttacctccattttctgtattcatgtcacagtatactctatacggtttgacagaactgtcaggttgaatgagatacatttcagatgtttcacctcctttcctgataatttcctcacattctgcaaatgtaaggacaacattatgttcaggggtttatggacataattactttgtatttaggtcaccaattctttaaaataacattacataagttactaagggagtgtgttattataggacctttgggaaaataatattaacanatattagggtttncattttactttaggtaaggtcccaacccagttttgaggggcggtttatctggctaggnggggtggaacaaggctcttctccaccttttgtgtccgggggggnttatccctggagggctcccgggnccacacaaatggggng

SEQ ID NO: 3184 - DNA, 480 bp, Homo sapiens
  Genbank Accession No. T68083
  unsure (1)..(480): n = a or c or g or t
ccagccgaaacnncnttgggggcaagaaacttcttgttagaactttccacctccggcttccccctccacctcttttaccgtcccaaccttaggagacgctttttctcccccagaggagaatttatctttttttttttttttttttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctagcccggctccgcggcggagnaatngggtgtgggaaacggctggggcgcgctgggtgatgttccctctnacagatgatctnatctgggtgggtggaaagcagccgtcgggactgggtgctgcccgccaagctgcnggaacctnttcgcggggagaaacgtnctcatcaacnggcggcggggagag

SEQ ID NO: 3185 - DNA, 469 bp, Homo sapiens
  Genbank Accession No. T68426
  unsure (1)..(469): n = a or c or g or t
tnccttctttattaaatgacgganaggattgttgtgattacagttgaaggcncgtnttagaaaggcaggtcatgaagnagagagtnccacagactcggctctcgaaccggggcaggagggacaaggtgagctgtcagcccacaggacgggcgggctgggtggacacagcccccaagttggccaagctgagtctctgggcgagtggctcccaggagaggcctggctgagcaggcagacaccctgggaccccagggcangaaggcccctgccctccagtccccaagcccaggcccttctccactcatacacgccacctacatgtgacgtcaccctgaaaaggtaacaggaaagttcagancaaaaacaaaaccccaaaantaaaaaggctacgtntagcanagtattcccggaaacnttntntncacaggcngtnntggccccctcggngttttccgggtcactttggggg

SEQ ID NO: 3186 - DNA, 381 bp, Homo sapiens
  Genbank Accession No. T68510
gatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatgggagctgcagattccattgcccaccaaagactaggaacacacacatatccatacaccaaagggaaaggacaatttctggaaatgctgtttcttctgggtgggttccctcttctgggcttgct

SEQ ID NO: 3187 - DNA, 440 bp, Homo sapiens
  Genbank Accession No. T68711
  unsure (1)..(440): n = a or c or g or t
ttttacnnnnctttggattttttattaagttctgcaataaataataggtttataagttcaccctgttgttganctcatcagtggtcgccaagtaagagggtgaatcactcatcccaagagactctgctacctcttagctctggagggtaaaaagcaagggccagagcaaatacattggggagagggggagaaaaaaaaaatcaggctattttaatagccctcacatgccaagtgcttttgattcatcatgtttagttttcataagcttgtgaggtagataatattatccccattttatagatgagggaatttaggctccaatggggntaaataacttgtacaagnacacatactggaatgactgccatgagggagggaatgtgaattttgggtcacggggccaacaccctacactcttcctacccntgccacactgggca

SEQ ID NO: 3188 - DNA, 453 bp, Homo sapiens
  Genbank Accession No. T68855
  unsure (1)..(453): n = a or c or g or t
ctgttaccctctccttttcactctctctcattccgttccctttcttctttcaacatctaacatggtaaagttttgtgctaataaccaaggcaagacaaaacttatattcatgttcttccataaagaatctcatatcatcataggaaggccaaggccagaagggaaaagaaagagaaagaagaggggaatccaaatgaatgtctcttagatgtctcactgcgcacgggcttttccggacatcttccactccttgtctcgaagcttggctcgttgaattttccctgtgacagtcttggggcaggttcaaggacaaactctatctttcttggggtacttgtatgggggctgtcactgactttcacatgctgctgcagctccttgggtgagctgtttctggggtcatgggggacagggaactncgaggccaggggnccacaaatgcctttcaccacc

SEQ ID NO: 3189 - DNA, 244 bp, Homo sapiens
  Genbank Accession No. T68873
  unsure (1)..(244): n = a or c or g or t
ntttttttttttttcaagtcaaaactgttttattgtcngtttacatatttaatagaaaaaggaatgtagcaaatgctcagggttgtatgaaaaaaaaatccaggtttgtgcaggttgctctgtttacatctgggagcagggctgtccccacatcaggcacagcagctgcacttctccgacgcccctttgcagacgcagccctgggacacttggcacagccatggnagaccaggagcagcagctc

SEQ ID NO: 3190 - DNA, 188 bp, Homo sapiens
  Genbank Accession No. T68878
  unsure (1)..(188): n = a or c or g or t
tttttgganttcaaaagacccntttattccaaagctgaggtcacaaatacaaaacttgcgccttcatggcctctgtcccctgccccccaccaccagacaattccccagccatggtaagatgccttntgaacctgcaatccctttngnaaaagaccccagtntttgctcctccaggntcccaaggccgg

SEQ ID NO: 3191 - DNA, 393 bp, Homo sapiens
  Genbank Accession No. T69009
  unsure (1)..(393): n = a or c or g or t
gttgaaanntttatttcanggatttaaatccacccccttccgagaacaccagattaaaagacctccagcaatccatgattctagtatactcatctctgactgctgtatgtaagatgtgatttgattaaagnangacagacaacangtgcatttattagggncaacattctgaatactcacgagtagttatcttgcacacttaaccctaggccagaggacacagggcaaccacacagganaaggntaccagggcagngtcactggagttttgcttataccacaaaaggagttaaggcagtttaattcaaggatgcgaaaactacgtctatgacataaaacntgacattcacaanttaactcagcctttaaanatgtccccaantaccaacnagt

SEQ ID NO: 3192 - DNA, 454 bp, Homo sapiens
  Genbank Accession No. T69020
  unsure (1)..(454): n = a or c or g or t
gtaaaagaactaatatttgcaaagaaaggggacgaggacattttctaataagcattagcaggagcagccacccccaagtacattttattcccaggnatatttattttgggactaatagcaatcaaaacagagtaagcggaaggtcttttttgtaagggtaagatgactgtgttcctgcagcctggacactgactgctgcaatgaaattggatctgttgagcatgtcttccaaggacagatttggatagtaagccaggtagaaggccagagctcccacaaagctntcaccagcacccgtggtatccacagccttgactttctctgtgggaatgtgctttggctcaggttctgtctgtgacagcaccacacatccttcagcccctaaggntaatgattaccacctgggcagccccttttcaaggagcactantgcagcctncccagcatcttncag

SEQ ID NO: 3193 - DNA, 469 bp, Homo sapiens
  Genbank Accession No. T69029
  unsure (1)..(469): n = a or c or g or t
tttttttttttttttttttttgggccaaaagaaagctctttattgattgactcagcaatnaagggntggcacccatcagcttcaaaccacatcttatcgcanccactcctgtccactcccgtccactttgccctcttccagggtgaaatcttgctttcaggcaagggnttccggcagccttgcattagttctcagctatggncttctgaacccagtcctgggtggaagtcaccttcacatacacaccatactcagccacagcacagctcttatcaaagcttaagatcccagtcgcataccaggggtcctcctccaggggcgtgaacggcaaaggcactgccgnatcgccatagcaggngtcttcttggnacttaggacatgccagcacagaaggtgtnttcattcagnatggggctgcacccctacagggctcttcggngtcttctttncggggactntgctgcctnca

SEQ ID NO: 3194 - DNA, 416 bp, Homo sapiens
  Genbank Accession No. T69164
  unsure (1)..(416): n = a or c or g or t
atgatctcagctcactgcaacctcctcctcctgggttaagtgatcctcgtgcctcagcctcctgagaagctggtattacagacgtgcaccaccatgcctgactaatttttgtatttttagtagagacaagttttcgctatgctggccaggctgacctcgaactcctagcctcctcatatgatccacccacctcagtctcccaaagtgctgggattacaagcgtgagcaccttgcacagccaaatcaagtcacttttaaaatacaaatttattatatgtctaaggacattatcgataaagtgaaaacacaacccacagaatggggaggaaaatatttggcaaaccatgtatctggataaggggtctaggaatccaggaatatattaaaggaactctttacaacttcaggtanttaaa

SEQ ID NO: 3195 - DNA, 419 bp, Homo sapiens
  Genbank Accession No. T69284
  unsure (1)..(419): n = a or c or g or t
gtgactaaatggagtttattccatcaaagcaaggttgatttaatttttaaaaatcgatatgtgttatgtataatatcacattatctcattaaaaagcatgtatctagcggcataactgtgtgtattaagacctaaaatatagtatcctgatactttactacacactttaaaggtgttaacttatttcatcatccccacaattttcatgaaataaggaatgattattttctctcagctgcaaatacatgggctggaaacacaaaggtaactgggctctaggatcatgtaggcaattaaggtgacagaggctgtggaatccagtttaggatagggcctgactgggnggcacttcattatattgtctttcagggngtctatacctgacctgggnggggctctgtattggggggggttggcct

SEQ ID NO: 3196 - DNA, 466 bp, Homo sapiens
  Genbank Accession No. T69305
  unsure (1)..(466): n = a or c or g or t
tttattctgccactgctacagggcccactgtcatttccagcccactgaggttgagggtatggccaggctgggattcacacaggcccaggatgaaagggacaccnngtgtnttggggtgggggtggctggctttgatccctaccccagtgggttggccaggtgatcagagcctccaggttccctcacacacagcctgggtacatttctgccgtcaggggccggaagactgggcccggttntccagtacaaacagagggtcaaccacgatccccacattgaagccctcacggcaccaaccgggtntttcatcagttttgaacgtgctgggtgacctccatgggcgtnctgggggatgcggatgaaatggggggntagcgtaggnaggggagccaagcgcgaacgttcttnggttacaactttttttccccgttcgaaagtttttggccggggnttaagcttncacagc

SEQ ID NO: 3197 - DNA, 234 bp, Homo sapiens
  Genbank Accession No. T69384
  unsure (1)..(234): n = a or c or g or t
ccccgagcttctcccaccatagggggccggaccccantcaccagcctaggatccagggctgcctctgnctcttagggagcagagagcagaactccgcagcccagcccagaggagtgtcacctcccacctttggagaggaatccttccctcccctggacaaagttgctgacaagtgctgaagtggcctctccatattccagctgagcctgaatctgactcttnagggttgggctt

SEQ ID NO: 3198 - DNA, 586 bp, Homo sapiens
  Genbank Accession No. T69728
  unsure (1)..(586): n = a or c or g or t
ctacttantagcaagggttccattccaacaatggattactactatgtagaccaactcctgtctgatttagatcttcctttcataaacacattgatacttgttcaaggacagctgtaaatacatccaatttcttttctttttatccccctctacaactctgcttggctacaaaaatctaggactcacagagcaacagcagcgatggtcagaaaataagtgccagttccaatgcaagaactctctaaagttcattggtcacaattttttttaaccacctcacctaccatgacttttttcttttctcattatctngccaattatttctttcgaaattcaatcctccgagctacattctgaggcaccaaattttttgaccaatgcctctctggggatcctcatcatcttttnggcaaatctatggncatcttgtcggggaccaaagggggatatccatcaggctctctggaccagacggctaggagggcgggaaggaggcctccaggttcaccactatttttagggnagggcctgtgnaactggtggaaggncccaggtaaaccttctccattaactgccgaaggaccta

SEQ ID NO: 3199 - DNA, 492 bp, Homo sapiens
  Genbank Accession No. T70087
  unsure (1)..(492): n = a or c or g or t
ttttttttttatcagactaagcaacttgatgaccaggaccatatcccctatttcttagtattctcttcagcattttagccagagtaggagtcggtgttgaatacaagtttgtcatcttatggattatatcttagggtgaatatcagagctggtgtccatcatgtgaacaggcagcatggtactggtggggagaggggtggaagtacagagtactagggccccaggagctaatattgctaacttgacaatattggtaaaagctagaccngttaagaactaccngcaatggttagtactgaaagcaaaaggggaaggattcatcaggctaaaataaaaaggggaaactagcaggttgggcataggggcagaacccangggaaaaccaaaaccaaaaccccccaaaaaactactaggatttccccgaaaagtggggaaaagcccnaaatctccaggnccatttaatgacagccaggtatttnccaaatgtagggg

SEQ ID NO: 3200 - DNA, 375 bp, Homo sapiens
  Genbank Accession No. T71012
  unsure (1)..(375): n = a or c or g or t
ttattgcaacanagtctggtttaattaataaanctttttggaagttttctttgacagacccnacataaataaatatagttttaaaagtggacttttaaacancagtttttcctttccgtcanggttttccnacgacaaggataaaagacccctcttccttatttgaaaattctcgcaatcaactagaactgaaattatgaacaccaactctgtcaaaactatacttttgttacttcttggggagcaagagaaatgaagaaancaaaagaaaatcatgtgctattttaatgtaatttatccnatacttttttcaaaaagtcacactcacgtctgcttgagagttttagaggggatataatgtatgaaaggaanttc

SEQ ID NO: 3201 - DNA, 454 bp, Homo sapiens
  Genbank Accession No. T71021
  unsure (1)..(454): n = a or c or g or t
attctttacaaaacccacacacacacatccacacacacacacacacatgatgcctgccctgctgtggtcactctggccctggngtctcctgggatcaggccctcctggcctctcccaggggaaaccatcctgcagcccctctgggtcagcagtgaaggagcagagagagggaacctccttttctgcttctctgctcaggaacagaggtctgtgccccacctntcggggagcaagtggaggtgacagagaaacagcatcctcctctttccaccgttgagcccccggagttgccagcctaggcccccaatntcacagctgccaaggcctgggggtcatctgctgattgaaccttccccatccccattttgcagattgaaacacagcggtccaaagacagcggacgagtcacccaaggtcacggtgctggagcaagtggcagagnagggacggggat

SEQ ID NO: 3202 - DNA, 390 bp, Homo sapiens
  Genbank Accession No. T71373
  unsure (1)..(390): n = a or c or g or t
ttttttttntttttcaagggttatttattaaaccccttggttctgaccccaagctaagtgggactcagcatcagaccctgcactcagagagccccctgacttggggaagacagagcagagaaaggcagccccagtgtggccagggctcagctggaaggaaggacaaggggctgggagaacccagagttcaagagatctgggaaacagggaacggcattccagacggagggcacaccttgggcatgggtaaggaaagcccatcgtntnttctaggaagcatggatggatgaaacggggtcccagccgctatggacagccccgagtttcacctntaaaaggcaggattatttgtttttaattttaattttaatttttttgagacagtcttgc

SEQ ID NO: 3203 - DNA, 177 bp, Homo sapiens
  Genbank Accession No. T71776
  unsure (1)..(177): n = a or c or g or t
ttttgatganggnngtaatcaatcttttattcacagctacaaactttaatcaattatggataaaacacaaaagctttttgaaatgctgataaaggaacccataccngagagaccaaataaaatccgagtnctgagctggccatggntttggcaggtcagcagcacatggaggcacag

SEQ ID NO: 3204 - DNA, 482 bp, Homo sapiens
  Genbank Accession No. T71978
  unsure (1)..(482): n = a or c or g or t
tatttaaaaagggaagtttattaatattggaagggacaaactggagagcacagaacatgcagctgtccaatttctaaggtgactctgctgtgacagtgattggcctctgtcccctgcagctgcgaggcccctgtctgagctggtgtgccaacgccttntgcctgtntcctccacccggcatcctgctctcccctgcattctgggaatgccatcctggacacactgagaggcctaggtgggtttntctccctgccacccacctgagtcctgccagtgctttggcctggnccctgggtctgccgccatcccttgtccagttgggttgaggcaccgtgtcttgggccttgtccctccaggggcagagcgcggcagccntttacccccacagcgttgcagccctgcagntgggncctnagccctggggagggagcctttccttttncagagagaacttggncctgcaattttcagcttncctatgg

SEQ ID NO: 3205 - DNA, 382 bp, Homo sapiens
  Genbank Accession No. T72171
  unsure (1)..(382): n = a or c or g or t
ctaagaataaatatttatttcaatatggaagtacaacatctgcaacagtacttatgcattttttttactattttcctgtcactgaagtgttttaccctcagggctagaatttcagatactacatcattaccactcactgtgccatttatactcaagctttaaatacatagtgtctgaaataaaatctagtttggtaggtggtaatgagttggcatgtacaggtagagggaaggttgttgaaggntctggggatacaaaagtaccantattcagtgaanttagagccaaaaaggagattcctacttaaacaagtggggacagggggtgctatatatgggaaagggagtctgattggggatacaggaaaaggaggggtctatga

SEQ ID NO: 3206 - DNA, 375 bp, Homo sapiens
  Genbank Accession No. T72268
  unsure (1)..(375): n = a or c or g or t
tcgcagcaattttaattcaatcccacgcccctgtccagcaggaaacccctttatagaaaacccaaatcctcatcttggagtttctccttcagccagggcagcacttgaaagaggttgatgtgaaagtctcgggcgtgannggttacctgcttttgccgnttctggtttttgcagacatccactactccccagctgattacaccaacttgaatgaaacganttctcttgtgaactatcaaggggccgccagantcacctntgcaagtnttggggtcagcatagggactcactcctccagtacaaagggaaccgaggggtgaccacctntgaggatgtcccttgantttgtcatagcctgggggcaatatttgaggc

SEQ ID NO: 3207 - DNA, 346 bp, Homo sapiens
  Genbank Accession No. T72502
  unsure (1)..(346): n = a or c or g or t
atgtcagaattttattcaatgtctttttcaggggacatagtttcacccataacaatggccacgaaaggacataagcagaagatactaacacagaacaacaaagacctaaaggtgcctttgcaaaaatcatgacctgtgaatgtgaccttatttggaaatagtctttacagatgtatttagttaagagcaggtaattngggtggaccctaatccagcatgactggggtccttagaagaggaaantttgggaaaaagacacagggagagcatcatgtgatgacagaggcagntcatgggagtgatgtgggctgcacccaggggaactcccaaagttccaagtgccacc

SEQ ID NO: 3208 - DNA, 141 bp, Homo sapiens
  Genbank Accession No. T72629
  unsure (1)..(141): n = a or c or g or t
gananantagagtttataattttggggcaggaaggaagtaactgtaaaaagaaaaacaagtgcaagttttctttaaaaaaataataggctgatgggacttgctatcgaaggggttgagttctaaaactaggactggtgagt

SEQ ID NO: 3209 - DNA, 322 bp, Homo sapiens
  Genbank Accession No. T72906
  unsure (1)..(322): n = a or c or g or t
tttttggaaatacaggaactcctttaatagtgcttagcttacaagctctccaggntggggatggagcctcagttagattgatacagtttgcagagtgcctggcttagtcgatgttcaataacatttggggcaggagggagtgaataaaggtatacatgggtgaacaaaataacacagtctaggctgggcacggtcgctcacgcctataatcccagcactttgggaggccnaggtnggcagatcacaaggtcagaagttcaagaccagcctggccaataaggtgaancccatctctactaaaantacaaaanttagccgggca

SEQ ID NO: 3210 - DNA, 252 bp, Homo sapiens
  Genbank Accession No. T73420
  unsure (1)..(252): n = a or c or g or t
attgtccatgggaggaggaggagggctggttgagctgcacancttccactgtcctccgggccaccgtctccggcttcagtgggggaaagaggttgggaaacctgactctcatgccctggaacatctcgntgctggtgtngaagggcagcactgtggtngcgcttactcccggacagtncagcagccccagggtcaggctctccatgaaggcgaaggttgacgctttggatttgcagtagtcgatggcaccgg

SEQ ID NO: 3211 - DNA, 346 bp, Homo sapiens
  Genbank Accession No. T73433
  unsure (1)..(346): n = a or c or g or t
gggagaaataaccagctattgttccgcattcaaacagaaattcaggtgcttgcatctttcacgtattgttcaaaaatcacaagcatctgtggaaaaaaactaaggtattacagacactacacggaggtcatgttcttacattcaagacactaaatacaaaccgangcantgcaaaattgtatactttaattttaaaacccantttttgttctcaacttgaaaagggnaacacttttttgtttcacaaacaagctgggtcgggttggganttctttttgggaacagtaggtcccgcgctaaacactgggttcttgcctccccacccccnttctctaaaatnaaccca

SEQ ID NO: 3212 - DNA, 241 bp, Homo sapiens
  Genbank Accession No. T73442
  unsure (1)..(241): n = a or c or g or t
tatttgactatgctgttggtttaattgtttatattggtnttccacggtctggagaaggtctttgatgctattatcttgtttttntacaaaanttttaagtgaagttacttctgggtgttctggagtttcaggttgattttgaattaagttagttagttgctcttctaaatatttcactttttgttgaagtagaattttttnttctaggaggctttcaagttttgagttgagttcaagngac

SEQ ID NO: 3213 - DNA, 332 bp, Homo sapiens
  Genbank Accession No. T73739
  unsure (1)..(332): n = a or c or g or t
agagtggggaggccttttattaaacattcccgggagcttcatggctggggantgcagctcatttggaaggcactgggttttgcgcccaagtggactttttccaggaggtgccactggagggaaaagggctgcctgggccagggaggctgcctggttctgcctcccgggntggntcattggctttcctntccccaggcctggaggaccttgcaggntctttttnctcctnatccctcaggntgggcatgggacangtttttgccantgccagctttttgccantggnaggttcacancttnttnttggggcattgntgcagggccgccctcag

SEQ ID NO: 3214 - DNA, 314 bp, Homo sapiens
  Genbank Accession No. T74542
  unsure (1)..(314): n = a or c or g or t
ggctgatggngccgagctttattggagcaaagagtntggacactntttacaacaaaactgtttccgggaaaacttggatttcccaagacccgaagactcctccaagttctcactgttagtaaggtcaatttgggggcagaacaggaacatgccttagctgctntcaggaaatagaagagcaganagagttgggcatggaggctccagctcaganttgggaagatggagaagagccntcccaantccagagtgantaggtttcatagcacccntntcctctntttnaaggaagcaggcccctaaagggaaacaca

SEQ ID NO: 3215 - DNA, 532 bp, Homo sapiens
  Genbank Accession No. T74608
  unsure (1)..(532): n = a or c or g or t
taagccccaaacgattggtctccccacaaacacagccttggnacaagagcagagctttcagaacatcagtgcctttccgcacacccccgtccaggaagacttccaccttcccttccacagcctccacaatttctggcagaacatcaatagtggctggcaccccatcgagttgtcgagccccatgattcgacaccaagatcccattcaagccatgtttaacagcctccctgggcatcatcacctctcaaaatgccctttgcaacaattggcaatgatgtcagtcttctcagccatttgatatcttcccagctgataggatggggtctatttgctttaggccacatatgcaggcaagtccacttgtcgtcttccaaaatttttcctcagggaggaaaatggataaagtactgggttttcaaaaatttttttcatcctggaggttgtggggcgggcagttttggaatctgtttacgggacatcattccaggacgggttgcccgggggaagggtnttgtnccactgttcacaatat

SEQ ID NO: 3216 - DNA, 174 bp, Homo sapiens
  Genbank Accession No. T74884
  unsure (1)..(174): n = a or c or g or t
tttgagnnntatctctctagtgtcacccaggctggggtgcacgtggcatgatcttggctcactgcaacctccacctcccaggttcaagtgattctcctgcctcagcctcccaagcttgaccacctttgacacctccctgaagagtatggagtgaagggatccagggccacagct

SEQ ID NO: 3217 - DNA, 289 bp, Homo sapiens
  Genbank Accession No. T77729
  unsure (1)..(289): n = a or c or g or t
tttagggtngggaaagccagctttattgagtaaacttcccaggacctggacatcttagatctccccttcccccaggagataggacccctaaacctcccctgggtcctaggacacctgacccaccanttntagtctccantgaggaggggacccttatttggcaagagatgaacatttaagcagctttccgccggagaaaggacgatggctgaaaggantgaaccaccgcagcngttttctctcctntccagntttggacaggacctccacggcccggcnttcctggctc

SEQ ID NO: 3218 - DNA, 487 bp, Homo sapiens
  Genbank Accession No. T77733
  unsure (1)..(487): n = a or c or g or t
atccagtgctttattaaaganaaatagtctcataagaggagaagtaaaagtttttgcaggccaacagagagtccatgtatatgagaaagagatgcgtgaggtccctgatctgtgctctgagggggtggtcagtcaggcagggnttgggcaaccagtaagtcagatgagggtccctntcctgggggnctcactgctcctgggtgccccaggagattntagtctggccntntggcgcantggtactcatcgatgagctgctgcacaatctccctgggatntntccatctcatcaaagttntccttgaacatgtcctccttgcggaactgctccagggaaggccntcccgnttacgcagctttgtcatactggcgacaggttctttcgaagaccgaagganaatgctggtttgggttggccatcatgagcccgttgaccccgtnggcccnaggcaggtagggaagacttcctcganagggccacctggga

SEQ ID NO: 3219 - DNA, 535 bp, Homo sapiens
  Genbank Accession No. T78433
  unsure (1)..(535): n = a or c or g or t
tttaaggagaaaatgaaatttgtggcatttttattttaaataattagtcttactttgcttttttaaattagctcttcatgcagcacatgtagaattcagttcttatattcaccatgcagctttttcttcccatgaggaacgtggctcagtgaaaatggngacttgatatttaaccgatccctttcagcctcctcttcctcatcgtatctctcatcctccacttcatcttccacatcactgctctgaggactggaggcctgagaccctgaaggagaaggtggnactgaggaaggcctggggatatttaaatccttctgtcgttggntgggtgatgttagttccacatgggaatttatctgggaaaagctctgcttaaatgtcagggngtctgggcatgctgggtaatatctgcctaaggtatctccaatccagaagatctgagagcctctcagttctgttccnctggataatcctttgggcggcgtgactgtttgcaaaatccataggggaacttaggtcagctgattgcaagaat

SEQ ID NO: 3220 - DNA, 420 bp, Homo sapiens
  Genbank Accession No. T78889
  unsure (1)..(420): n = a or c or g or t
ttctccttttccngttcccaagacatgtgcagctcatcatctggccattttctccctgacggtcccacttctctccaatcttgtagttcacaccattgtcatggcaccatctagatgaatcacatctgaaatgaccacttccaaagcctaagcactggcacaacagtttaaagcctgattcagacattcgttcccactcatctccaacggcataatgggaaactgtgtaggggtcaaagcacgagtcatccgtaggttgggttcaagccttcgttgacagagttgcccacgggtaacaacctntttcccgaaccttatgcctctgctgggtcttttcaggtgcctccacttatggatgttgtagggtggggcacctctgggtnagggggcctgtcagaggtggggcactgggtaggaagg

SEQ ID NO: 3221 - DNA, 273 bp, Homo sapiens
  Genbank Accession No. T78922
  unsure (1)..(273): n = a or c or g or t
gattccacaaggatttattggcaccggacctagcctggnnccgccccttcaaggaaagacactaacaaggaggagtgccggcaccgcaagagccctcccagaagcgcccagactgggggtcggggaggacgctgccattcgtggccaggaagggaagggcgattccggagaggngtgggcacggcgcagggaaaggccggntggtnggntnggcagggaggcggggtaccngccccttaagaaaggggaactcgcagacntagtagagacgcc

SEQ ID NO: 3222 - DNA, 389 bp, Homo sapiens
  Genbank Accession No. T79477
  unsure (1)..(389): n = a or c or g or t
tttttacagtaagaaaagaactttattgtttattaaatgtttctgtgtaaaaccttaagcttttnnnntttttnaaagaaacaccaccaaaaggggattagcttagtccatcccttcctcagtcatctgcttcccaccttcctccaaatgttatcccagaacattctggaggcagggagaaggggaggcagctaatcagagtctgagagcacgatgatctcttctgggatcgcattgtgtgggccacacttgtcttgcaagtaccagggccgagggagnctggtggaatggggggggtttgggggacagccgggctgggaggaaggggatgcagaggggagctgggtcaccggggccatggcttgggggagagttcccccctcgtggga

SEQ ID NO: 3223 - DNA, 379 bp, Homo sapiens
  Genbank Accession No. T79758
  unsure (1)..(379): n = a or c or g or t
ttgtagagacagggtttcaccggtgttgaacaggctggtcttgaacttttgacctctgatgattcccagcttggcctctcaaagtgctaggattacaggcgtgtgcactacacctggcttcagantcctaaagtgtcaacattgcccaagttaatatatacatttaatgcacttctggctgtgttcccaatgctctgaaagggttagcaaaacctcttttcttttttcacagggaaaatgataataattcaccttctctaggtactatttcctttaaatcatggataatggatggtaatgtcaggtgtttgggcaggggnaacactactttttaataaaaatggacccctatttgggggntaactggcantgggngggg

SEQ ID NO: 3224 - DNA, 403 bp, Homo sapiens
  Genbank Accession No. T79842
ttaacatggaagaaaagcaattttaattgttacaagggtgtgcagaaggacacctctcaggcttagaaaatcccacgtcacccgagatctatcctcaaggcttcctctgctggccacacagggaagtttggtcttcagagaggttctgatgctaacaagccacagggttgacgaatacaaatgtcaaaggtgtaaatcaacagaagattaaagagaaaagaggaggaaaagggtgataactcattggctgatgccatttaaaaacaaatggggtcagagacttctggagtcatgtggcagggcaggatgtactcctgtaggcactgatccgcagagtcctcaaaacatgccacgccaacttttcacctgaatctcttccaggaacaagcactatttctattaa

SEQ ID NO: 3225 - DNA, 519 bp, Homo sapiens
  Genbank Accession No. T79863
  unsure (1)..(519): n = a or c or g or t
ttctttataatatttttattaataaagtagaagattcaatccaaaattactagataaaaagaaataggaaagtgtaacccacactcaggaggaaaggtaattaacaggaactaagcccaaaatatcacagatgtacttgtttcttattttgatatgatggaaatgcactgaaaatttaaagattaaataaaatatggcagtatagtgatatgcatgacactttaaaatgctgtcangttggctgggcatggtggtgcgtgcctgtaatcccagctacccgggaggccgaggcaggaggantcgcccgaacccggcaggcggantttgcagncgaccncgaggntcttcccattgcactccagcctggggcgacaggggcgagactctggcatccccggaggtcctcttngttgttaaacagttccttttcaattggggtctgttctcctcggtacaacagatttggggatntttctttccgggggggncatcttttgaccccttttgccttgncagttt

SEQ ID NO: 3226 - DNA, 495 bp, Homo sapiens
  Genbank Accession No. T81315
  unsure (1)..(495): n = a or c or g or t
nttgttgaatgaatactgcaagaatgaagagcagacaaggaagctaagatctaatgaaagagaacaacatgtgggcagtatgtcagtgaacctttttatatggttcccatcaggctgagacccagctcttgggcaaacaacagtctcaggtaggcagatctattactcgagggtaggggctgagactctaggggcaatgtcttgtgctgggcgccgcgaaaccctgctcctgccctgactggggtccatgtcttgctgctggctgaggggtagtcagggacatgctccttggtagatggggctctcttgttgacttgtgggccccagaagtcaaacaaacccctgttgtttccctgggtaacattgtctaataaagggaaccactttataggcaatttgaaagtcttcatccatggacttaagccagaggaatagttcccttttcatgccgagctatttttgatgggattagttgatcttttaactctgaccaaa

SEQ ID NO: 3227 - DNA, 456 bp, Homo sapiens
  Genbank Accession No. T81393
  unsure (1)..(456): n = a or c or g or t
tntttnttaaaaatatttattgagcatgtgcnttnncaaacacataatttatttggaagacgtctacacaactgtactatcccatgcagagtcccatcgcatacatcgccaccttagctcgcacgctgagccagggcagtnttccctacacgccactggacagcctgtnaatcctacgtcccacacgagtngatgagcgacggcagtaagggcaccantaacacaggaggtggggacagtcactntcacagggtacacgggctgatatgcgtgcgtcctagggagtntagncctaggacctagcttagggaacatgggagctccgacccagccacggggtggccacttgtgggggcacccgggggtgnaacacctggggggaaacacagccttacttttttaggagggggcagacacttgggggcagcggggggttgggccacgggcaggctttcc

SEQ ID NO: 3228 - DNA, 292 bp, Homo sapiens
  Genbank Accession No. T82254
  unsure (1)..(292): n = a or c or g or t
taagttttattattataattacaaattaattcagagaaactgaagccattcttcatacatgacaaacatacatttcctctgtgtgtacagcacacaagtaatatacacaaatatattccatgtctgaacaaatcctttttaaaactttaaaagctggctgggcacagtggctcacgcccgtaatcccggcactttgggaggccaaggcgggtggatcacaaggtgagaagatcgagaccatcctggccaacatagtgagaccccacttcattaaaaaaaaaaagagntaaat

SEQ ID NO: 3229 - DNA, 407 bp, Homo sapiens
  Genbank Accession No. T82259
  unsure (1)..(407): n = a or c or g or t
agcatttggacanggttgaggcattcactatcaatttactgctttcctcaagcaaaaaggtcaagtattcaacttaagctgcaacatcagcaacacttaccaattataaattcctgaatgaggtcaaatgaatggcaggcagagacattctcagaaatccactgaataatctttaaaaagtcagacagaactctgttggtatttaaatctgctctctgcctccactaccaaagaagtacaaatatacatgaatcttttgcattctatacctattttaggaattgcctaaggaatatactcacttctatactatcttcaaggatacataatgcaattctggggtagggtaaaacgggtattttataaggtgaggtcccttttttatacatctttttaataaatctcct

SEQ ID NO: 3230 - DNA, 294 bp, Homo sapiens
  Genbank Accession No. T82323
ttttttttttttacacagcaaatcccaagccttcccagtctcacacctttccacccattcataaaaaaacacacgaatttctcgcaagttccaatatcactgtctctttatcatctaaatagggccagttggacacctcattgaaacaaaaaggctgatctagatgaagtactctttcttttcttcggagttgttctgtcctccttctgcattgattatagctgtgtctgcgtctgctgcgtcatcggctcctttggcttcatgagtgaagtatgtacctttatgtctggcaaa

SEQ ID NO: 3231 - DNA, 394 bp, Homo sapiens
  Genbank Accession No. T83356
  unsure (1)..(394): n = a or c or g or t
tttaaattcagtagctttatttttaaatttcaattagggtcccttggatgaacaagaaacaaagtgtgacattttatgtggnatctgaaaaccacccttagnatggctttacatcggatgcatcagttttccaaaaagccagagaactgtgttcccttgaagcatttggggacttcgatagtgccatctatacactgagcatcctctgtatagctacacttcttttccttatttttgcagaaggaaagaaactttatcacccatgtaggcattcccattccttaaatttttccctggaatcctttactctctctccttggggacaccacagtgggcttttttcacaggggacctttaccaaggatgcctttaccaancttgggccntgggcagg

SEQ ID NO: 3232 - DNA, 441 bp, Homo sapiens
  Genbank Accession No. T83397
  unsure (1)..(441): n = a or c or g or t
ctgcctggttgtgctcccaggcacgcacaagggctccctgaagccccacgattaccccaagtnggaggggggagttaacaaaatgttccacgggatccaggactacgaggaaaacaaggcccgggtgcacctggtgatggagaagggcgacactgttttcttccatcctttgnctcatccacggatctggtcagaataaaacccagggattccggaaggcaatttcctgccatttcgccagtgccgattgccactacattgacgtgaagggcaccagttcaaggaaaacattcgagaagggaagttgttagggaataggcacataaaattctttgggaggctgnaaantaggcgtngaantttgaagggttattttgggatgttttcggagcttcgatttgttgnaaagggaggaaagaaccattttttggaattaggcct

SEQ ID NO: 3233 - DNA, 438 bp, Homo sapiens
  Genbank Accession No. T84084
  unsure (1)..(438): n = a or c or g or t
tatttttccatttctttaatcttagcaaactttttattattattattatcaagaggagagtntgagaaagatgtgatggcaacccttaaggtcatttaaaaactttacactggactgtacaagatttttttttgataaactatttacattttcagactttcaaacatattcaaagcagcaatagacactagtttttatgtttttttctttttttctaattgcccaaatagttaccagccatgggccaagtaggtacctgcattatacatagaatttctacaaagnaaatctgcagttaaaatttgctccaggggtgtattaaatgcccttagcaattcaagggccacacccagtgttgctataggggaccaaagcacaggtacccttgacaacagaggttgccaggttgtccccaaccagcccnttccacaaaccttt

SEQ ID NO: 3234 - DNA, 389 bp, Homo sapiens
  Genbank Accession No. T84491
  unsure (1)..(389): n = a or c or g or t
acagggacatgntaggaaacgatgaacctaactgggcatgaagatgtctagggaaaaaacaaggaagagtaaaaagttacacagaatctatgcagcggcaacaaaatcacttttaagggtgcaggagaaaaactaatgcaaatcttaggtcattagggagtctccgagccattcacataatttgcatttcttacactccttatccacagcacaatgaaaccccaagagaatccatctggagagagcgaaaggggatggattccgggtgttttggggtnagggacagggggagaaggtccngtttcaacaaatgtgacatacggggaaagtcagacgactttaactntaaacttngataatggnagttacaaacccaaataatcaggcag

SEQ ID NO: 3235 - DNA, 408 bp, Homo sapiens
  Genbank Accession No. T85532
  unsure (1)..(408): n = a or c or g or t
atcgcttgaggccacgagttcaagatgaggttggcaacatagtaagacctcatcactacaatttttttttttttaaattagtgaagtgtggtactgcacacccgaagtcccagctacttgggaggctgaggcaggaggattgcttaagcccagaaatttgaggctgcagtgagccatgattgcaccactatgctccagagtctaggcaacagagtgagaccttatctctttaaaacaaacaagaatgaagttaggtatctgtttatttgtttgagccatttgtatttccttttttgtaggactgtcctgtttnaaacgttaaaatcactgctgtnggttttngatttttacatctcagctgggatgggcaccaattaaattatttnaggccctggtttattgnaaaat

SEQ ID NO: 3236 - DNA, 416 bp, Homo sapiens
  Genbank Accession No. T86464
  unsure (1)..(416): n = a or c or g or t
ttgagacgganncncttctgttacccaggctggagtgcagtgccacangtctcggtgtgtgccatcatgcccagccaatttttgtatttttagtacagatggggtttcgccatgttggcaggccgatctgaactcctgaactcaggtgatctgcccgcctcagcctcccaaagtactgggattacagacgtgagccactgcgcctggctgattctccagaaatcttttggcatcatcattaataaaagcatcaagaagtcaaaaaggaaatcaagtgatcctcccgcctcagcctcccaagtagctggggctacagggtgtgcaccaccacacccgacttaattttctaaggtctattttgaacaagagggaagacttgaataaaggttgtctctaataaatttcaaggacatttt

SEQ ID NO: 3237 - DNA, 405 bp, Homo sapiens
  Genbank Accession No. T86482
  unsure (1)..(405): n = a or c or g or t
ngggaagtgtggtctggtnctgtcttggagaaaactacaataagagcgataattgtgaggatacaccagaggcagggtattttgctgtanagtggtgaagaaatcagcttctgacctcacctgggacaatctgaaaggcaagaagtcctgccatacgnaattnggcagacaccagctggctggaacatccccatgggccatgctctacaataagatcaaccactgcagatttgatgaatttttcagtgaaggttgtgcccctgggtctaagaaagactcccagtctcttgtaagctgtgtatggggctcaggccttaaacctcttgttgaaccccaacanccaaagaggggatactatgggctacacaggcgctttcaggtgtctnggttgagaagggngatttn

SEQ ID NO: 3238 - DNA, 499 bp, Homo sapiens
  Genbank Accession No. T86978
  unsure (1)..(499): n = a or c or g or t
ttaagtgattaaaggcaattttattacagcagcatgtacnttattctattctaaaagaataaaattcataaacagaaacagcttttatatttgtttgcaatctgcaaaattgagttattttgctgatataaaatactaagaactcacttgaggaccatgccaccttctgaaaaggccacacaccttcttcttaaatgtgttaaagttacagcgtgtcccagactcatccagagcaaaataagtaagcaactgactgctcttgactgtcccttccccagcactagcactgattgtgctgggacaagccacagagcaaggctgcacagcantatgggaggaggctttttatttaaaggcaaaattcccaanataggctctttgggtgtagggngatttcttnctttcacaacttcaggcttggtatattaattncctttcctcctttaaccggggcttgatttggggtttgncttgttgggncatgggnatcccnttaggt

SEQ ID NO: 3239 - DNA, 338 bp, Homo sapiens
  Genbank Accession No. T87174
  unsure (1)..(338): n = a or c or g or t
ggtgaattattgatttattgcacatcaggagaaacacaagattactgctataataaattcactcttacatgctttagaaaaatcagtaaaaatagaaaacatggtaacanttaaagtgaaaaanttggggtcattaaagaatgtctgactgattagcttgcagtttttgagacggctgagaactaccatcaatgagatcaccttaaacaaacactcttaatgacttggaaaaagtccccntcccaaagtcaactntagggnattcaatattgtgatatttaactggaatttaaggttatggtttaaaccccattttattgaggtaggngggagggatt

SEQ ID NO: 3240 - DNA, 498 bp, Homo sapiens
  Genbank Accession No. T87224
  unsure (1)..(498): n = a or c or g or t
tttttgcaagtaatttctactgaaatatttatttctgagaaacaactcaaataatttaatttcaattaagaaattaaatcaactcaaaataggaataagacaaactcattatgcttgcttcagatttcttctacgtggccaaaaatgctggggtcttcaattgtagaagnnatcttgtatggcttgcattgacaatggcagataaagctgatcgggggatcttgccagatctggttttgggtagctgtttgacaaacactgcatttcgaaaagcagccacagggccaatgttctgtctaacgtgtttcacaatttcttccaaaacttgctcctctgttgcatttatatcttttctcaatacacagagtgctaagggggacatggaccttttaggggatctttccttgcccaaccaacaggcacaggtctgccacgggtaccctgggggaaagggnttggactcttcaatggggcgcctggcaggaaattctgtggacc

SEQ ID NO: 3241 - DNA, 469 bp, Homo sapiens
  Genbank Accession No. T88814
  unsure (1)..(469): n = a or c or g or t
actatttgctgggacaggctaggcactgattctgctggttctgagaaacataaatggtaccatagggaggtgtttcctcctaagtggcaggaggatgtttgctgggagttaagtgaaccaattcctcctctgcttacaccacgtgggggtaggtccagaactcaggccttgggaacatatgctgtgctctcttctacaggcgctgtgtggaagaaccaatagcagttgttaaatagctgtgggaatttccctcccacaatccacatagtggatgtgtctcccaagggagctctggggtcatgagggccaatgtatggaaatctttcacttgaagttccgcatgaaggatcactatggttgtncaccaggggntctcagggtacccntgcagnaaggaggtacacatanggggaaacgggtcntcccatntcgggcctttccccggtaaanttcacccactggtgnttca

SEQ ID NO: 3242 - DNA, 408 bp, Homo sapiens
  Genbank Accession No. T89601
  unsure (1)..(408): n = a or c or g or t
gcaacatttattgaaacttatattagtcaagcaacttaatgctaggctaagctgcagtgagtaataatccctaacctcagtgacagtgcagaaaaagaagggtttcatatctggagtgtgatgcaggtcaatgggagtttccttcacctggtgactcaggtatccaggcacattcatttctgcaggtctgccttcttgacatgaggtcactgcagaaggagagagggtntagagtcatgccagttcttagggtgctccctgacaaggagatcctgcagcactctgcttcacattcctgtttttccagaactcagcccagtacccccaccanaacttcccaaagagtcttggggaagcataggaggaggttcaccagataggcctnggagatcccctcatcactttttg

SEQ ID NO: 3243 - DNA, 494 bp, Homo sapiens
  Genbank Accession No. T89703
  unsure (1)..(494): n = a or c or g or t
gtagaaaacaaaaatggaacatttattngcaactcaaatactacgcatatacagtaagaanttaaatataaacacagcaagttccaccccagtcctatttgtccaaggctgcatggtcaaatggaatcttgaagagaacacctggncaacagagcanctntcagcgacgtctccggtctggacttctgctgcgtcttcggccacctctccncttgccttttggtggaccccgaacaaaacaccagtcaacggtgatgggctgtcccatcaaatcctgggccattgagtccctccatagcagcctggggcttccttgtatgtttcatattcagctaggagtatacccctgtcagatatcctgttcgcctgtcgaggttgaggatgaatgtttttaatttccccatattctgcggaatttgtcgtgtatgtnttctgcggnaggcttcctcatggacttccagttacaaagagantccagncttcagcagagcgtt

SEQ ID NO: 3244 - DNA, 331 bp, Homo sapiens
  Genbank Accession No. T89731
  unsure (1)..(331): n = a or c or g or t
attttttgtagagacagggtctngccatgtcacccacgctggtctcaaactcacgggctcaagcaatcctcccatctttggccccccaaagtactgagaccacaaacatgagccatcttgcccagcccctagaacgtgttatcaaataaacaccgatgcaaccctcactcagccgagaagtaaaacattgccagccaatccctaaatgcttctgcttgccgcttcccaatcctaaccaatgccttctcctgacaattatgatgggtcatgtctttgcatttctctaatgtttcccatcacggatcaaactaggttttgttttgcctcgtgc

SEQ ID NO: 3245 - DNA, 289 bp, Homo sapiens
  Genbank Accession No. T90037
  unsure (1)..(289): n = a or c or g or t
aaggngttgngattgctttaaagaaagctttatttactacatacatcctaagaatgtactgtaaatggagcaagatctaaataaaagcttttcaaatataaagcagctaaagttaactaaaccactagcaatgtttgaaaacagaactctaaaactttttttttacatttatatagtttgttcttaacactaaaaaaaaaaaaagttcacatttcaagttataaacttaccctcaggtaggtgtaccatggaaatgggttttggaaaccataggggnccaggtaggccc

SEQ ID NO: 3246 - DNA, 391 bp, Homo sapiens
  Genbank Accession No. T90190
  unsure (1)..(391): n = a or c or g or t
tantnntccagctcttttattgagatcagtggtggctctgaaaagcgtntttngggttttagaagtaggcgttcgctaatttcttcttgggcgccgcttcttaggcttgacaaccttgggcttagcggccttggnttcacagccttagcagcacttttggcagctttcttgggcttcgcaaccttggccttctttgggctcttagcactttcttggttacagtggccgcggcggctntcttcgctttcttcggngttttcttagcgctcttcttcggagttgcgccgccagccgcccttcttgggcttcttggctnccccaactggcttcttaggtttgggtccgcccgccttttnaaccntggggcttggncttccccggagcttgcctt

SEQ ID NO: 3247 - DNA, 465 bp, Homo sapiens
  Genbank Accession No. T90492
  unsure (1)..(465): n = a or c or g or t
ttttaaaggnnnnaatgtgactattttaattattttggtggcagggagttggttttacatcacccaaaaaaaaaaaaaaagccctggtttcaaattcattggtaataaatatgctaactttctgaatcaaaatggagagcctctcaagaaaaagagctatgcagtcagcaatgacttaaattagtcaggatagcaggcatctggggttaaggctgtttccaccattttggtctcaccaccatatacgngtgggaccacagctgtgtagcacttgtttcngtcataagtntagcaggtctctgtagcactgtcttcatcacagatattgctctggggtagcagtaactatctgattatcccagctccacttctgtagggncacattttttacagaggtcagacaaatgggtacacaaatctggttccccaatgggtnaggtngggtccagagntattctccccgtt

SEQ ID NO: 3248 - DNA, 159 bp, Homo sapiens
  Genbank Accession No. T90520
ttttttttccattagaagctgaagttttattataggataacagtacataaagcacatctaaaattgatgtgttcaatgcacttttaataaaggtaatgtaatattaaaggtacagtttctaagtacaatataacaacattcatattagaatgaaaattg

SEQ ID NO: 3249 - DNA, 450 bp, Homo sapiens
  Genbank Accession No. T90531
  unsure (1)..(450): n = a or c or g or t
atttttcaataatttagtttttcttttgtgctcttttttttttagtagaagcaggaacagttgtcaatactaccttctgttggtcccctgttagacaacatacctttctttgaaatgtaaaatgtcaaatatataatgacacaactttagaaaaaacaaactttgacaacaccaacaacaaaaaatcccaaaataaaccagagatttcatgccatataaataaagtcagagcaaatctcgtgcccaggggctggtggccccagttccagggggcgggtgatgtccagagctgggtgtgggctctcgggggatcctctgggtaacagggcgtgatgggaggccccgtctctcctttcccgacagaggccaaggtcttttcccaaggtcccccaaggcaggnttaggtacaggggttagggggtgaacccggggaggcttaaggttgaggga

SEQ ID NO: 3250 - DNA, 268 bp, Homo sapiens
  Genbank Accession No. T90841
  unsure (1)..(268): n = a or c or g or t
tnnntatactcaatatttattgaatacatggatgagttcttccncccccatcttcccctgccctccactccccagctccaccttccacctgcccttacctgccaggggtctccccccactggaagcccgccctccagggtccccccaaggacctcatagggagccaggggggcaggggcgggggaagtttcccatagtctacgagccatcccagcccactagctgggagcagggccctgtccagctccagccccagggtcgccaggga

SEQ ID NO: 3251 - DNA, 252 bp, Homo sapiens
  Genbank Accession No. T91116
  unsure (1)..(252): n = a or c or g or t
ttntttttttcaccaattacaaaaaggctttattatattttgccaaatgttaatcgctttcattatgtctccaaacattatttcaccactcatttttataacaagtgcagtgaagatatgcttatcgaatattgtacaatactgttgtgttctgtaacactctttcgggaacagcttagatgtaggtaacaagagatgccngcgtatgaaagngcttcataaactgtactgtataaatgtaaactactaccc

SEQ ID NO: 3252 - DNA, 271 bp, Homo sapiens
  Genbank Accession No. T91161
  unsure (1)..(271): n = a or c or g or t
ttctgacaagaaggctttataatttccatttattgtagaataatatagtactatcaacatagaaatcatgtgtataccatttaaaatcataatttaaatgattttcattttagcaattgtggctgctgggatattataaacctgcttaaatattgatacatagngtttaaaataatattataattatgcanttttggggaaataaacattcaatacccntaataggtgcatacaattgggagggctgcnattaataatggtttccacnacc

SEQ ID NO: 3253 - DNA, 423 bp, Homo sapiens
  Genbank Accession No. T91348
  unsure (1)..(423): n = a or c or g or t
aggaaagtgagttctagagtgatgaatttagtttacaaataaggaaggtgagtcctagagtgattaatttgctcaaaaatgcacagagaaaacattaggattagaacccagatcaattgaacctagtccagtcctctttctaccttggcatgttgctgtgggaagaacacatggacagtagtccaggttcatacctctgtaaatggggagacagcctagcctagcgttttaagatcacacactctgaaatcacctgggctgcacctccagggatatgtgacttgccaaccaaattatttaagtcctcggatgcctgtttcctctttgttaaactgggggattaattaataattaatttcctccatcttnaaaaattggggggcccgggcatggtnggcttcatacctgttaatccccggatac

SEQ ID NO: 3254 - DNA, 283 bp, Homo sapiens
  Genbank Accession No. T92935
  unsure (1)..(283): n = a or c or g or t
caattgctgtnctggtacatggttcttcctcagaaagtggttcttccttaatgtgtttctttttaccccttttcttcttcttcttcacagatgtttcttcttcttctgccactttttcttcttcctcttcttcaactttaactttaatcttggcttttttggctttcttttcagtaatttcatcctctttatctacctgttctattttgcgttttttagaacaggttggaagtgtggagtcaccagaaggatcgtaagtcttcacttcacttttgtgttcata

SEQ ID NO: 3255 - DNA, 270 bp, Homo sapiens
  Genbank Accession No. T92950
  unsure (1)..(270): n = a or c or g or t
cttcctcattcattagncaagattacagactaggatatagcaacctattattcaagaacagcttttaaaggtagctgcttcagactggcacttcgggaaaactttgaaagtagacttctttttttttttaatgcttattttaactatagattggtgataacgattcaaccccagagatccagctaactgttggcacagaaatccttaacgctactctcaagcaaataagatcttgtaaggggaaactcctgcaaaatataccttgtgaac

SEQ ID NO: 3256 - DNA, 308 bp, Homo sapiens
  Genbank Accession No. T94452
  unsure (1)..(308): n = a or c or g or t
ctgtcacttctactgtcaagatggttgagagttgacagtttgtctagaagaaggctgatatatgtcaacatggtcagcaaaggatttaaatatgggtctttgaataataaatagctaataattgagtttattaaaatgaatttttgtataatttaggcagttgaaggtctagaacagcctgcgttcctttctatggcagcttgctatgaaattcatgtttcaaacaaaacaatactttttcatgcataggataaattataaatgtactgaccnggcccattctatatggttaattctnacgganttta

SEQ ID NO: 3257 - DNA, 424 bp, Homo sapiens
  Genbank Accession No. T94862
  unsure (1)..(424): n = a or c or g or t
cacttggattataatccatcctccaacacacacacaaataagcagctaatggcaatgctagtggtcttcccaattcacaagacctgtgcttcaaattgttttcctgataatgtggagaaatctgctctttatgtattctcaagaaacaggatgtgaaaagctggtatgggtatacaagataaaaatgcctacccagagtgggcagaagctctaaatattactggtttgctaaaagtttcagatgctttttagttctacatttgttagttctacctttaacctctctaccactcaacgaaccatcaagaaacaaaatctactccctatggtaacagtaaaggtcaccccagacttaaccttccaaaagggggtttttacttttaaagggnacagctttcacaggccactgcttttccataggggg

SEQ ID NO: 3258 - DNA, 419 bp, Homo sapiens
  Genbank Accession No. T95057
  unsure (1)..(419): n = a or c or g or t
nttnaattcannntnccaattaaanctttccttttttttnatgaaaaaagaccacacagaatttgccaacaaacaaaattccaaaagaaacataaaaaaaaaaaaccaataattcccccaaaaaacaaacccaaagtctggctttnccttccctcaagattgtctggttgaggccttggnttcccttgaaggcttggggcctgggttaagtgctttctggggcccaagcagggaccctgggcttgggcggctcctgcctctccctcttctctccctaacaaacacttctctatcctggggggtgagtacagtacacttggcggggtgggcggggggntttgctggggantgggangccggntgaagccgtagnctaggacactataaatcttaacagggaaattaaaaanttaatattn

SEQ ID NO: 3259 - DNA, 365 bp, Homo sapiens
  Genbank Accession No. T95064
  unsure (1)..(365): n = a or c or g or t
ttgcaaataacagtgtttattgatgatgagtccaggtggtagaggctacagtgagctgtgatcatgccactgcattccagcctgagtgacagagccagaccctgtctcaaaaacaaacaaacaaacaaaaaaaagntcactcagggagcactagagggccactgaagagtgccggagaggantcagattaccaggtaggagctgctgcgtactccaggcaggagtnttacatgaaagtgactgaaccaaggcagttntcctgagcacgggagagtggaagcaggctgaaacatcactgcttaggtntgaaatctntaaaacctttgggctaatatgtaggattgaggaggggaagggtgcccaac

SEQ ID NO: 3260 - DNA, 454 bp, Homo sapiens
  Genbank Accession No. T95515
  unsure (1)..(454): n = a or c or g or t
agaactttggagtaaaaatngtctctgtttccaagacgtgtgagatgtctgaactctgagatggtgtttcatctccacccgatttcaccaaaggggtgtcaatatctttaaagaactgatcttcagtaggaattggtgaggtggcaaggtaagcaggaagcttttcatattcttcttcagtctcctcaacaaagaaagcttctccgttatcacccaacttcatgtgaagatccactgcactgccgttgatttctatatcaatcactttctctttgggatctcagggactcccagctttcccaaacccgaacgtggaaaagggtgaacactggatagcctgcccatcctgctgctgtacccacggatggacatcaaatgcacccagagaggggtggcctggggttaatgcccttgtaggagttccttcacagtgacaatcaccttgcccagccan

SEQ ID NO: 3261 - DNA, 257 bp, Homo sapiens
  Genbank Accession No. T95813
  unsure (1)..(248): n = a or c or g or t
antttcggcacngaacccctgcggtgcacgnctccctggacaagttcctggcttctgtgagcaccgtgctgacctccctacccctccttctaactttattgctgtattctcttcactctatatttctctctatttgctaatattgcattgctgttacaataaaaattcaataaagatttagtggttaagtgcaaaaaaaaaaaaaaaaaaaaaaaaaaaaaaaaaaaaaaaaaaaaaaaaaaanaaaanaaaaaaaa

SEQ ID NO: 3262 - DNA, 169 bp, Homo sapiens
  Genbank Accession No. T96060
  unsure (1)..(169): n = a or c or g or t
ttcacaaaggtttattgggtccctgcctggtgctggtttgggttagtcactgtagaggatccatctgggccagcctgggaggggcaggtctggagtccnaggcagacacgaaaccgggggtgacaccaggggctttggaggctgccatgctgaggacagctctgggagg

SEQ ID NO: 3263 - DNA, 396 bp, Homo sapiens
  Genbank Accession No. T96969
  unsure (1)..(396): n = a or c or g or t
taggtgagtttattaggacttaacatacagggcattcctaggtggtagcaggacaactctggaaatttgccccacacacccccttaccccacccatcttcaagctgcttttaagctaattttctggcttttcttctctgtgtgtgatgagtgtttttcttggtatgtccccaggtactctcccaaatgtttgtgttctcagggaacacagcacatggtgttccttggctgagcaccatgaccttggctcaccacccagtcttcagggctcaagcagtggacatacacccttaagtaacctgggtngagaacccgtcgcattacacttggggttacagactccagtgtctgttaccatcttcacatggctttcttctctgtgattctcctnttctct

SEQ ID NO: 3264 - DNA, 325 bp, Homo sapiens
  Genbank Accession No. T97234
  unsure (1)..(325): n = a or c or g or t
tgttggccagggtggtctttatcttctgacctcatgatctgcccgcctcagcctcccaaggtgctgggattacaggcgtgcacctgcacccagccttgttatttattttctagattttgctagtgtctaggaatagtcctgattgttcccttcatctggctcattgatcggcagtcagctcctgggaattccttaaaactgcgtcacttccactctcggatcctcttgctttgggttctctgggggtcttttctctcatttttctcatcctggggatgggtgtcaaacagagggcttgttcctggggtttcagggaaggagggan

SEQ ID NO: 3265 - DNA, 242 bp, Homo sapiens
  Genbank Accession No. T97679
  unsure (1)..(242): n = a or c or g or t
tatggttattcaatatattcatttatttgacaattatttattcatttgacaattattcaatgtttactgcataagcaaaaaactgaataagacggttttctgcttttataaaacttacagttaagtagaagggacactgcataagaagtaacatgggagaaggctcaagtgttgacaactgtgatgaagagagatggaggnccngaaggaaattcaactgtggccgagaggcaactaaaagg

SEQ ID NO: 3266 - DNA, 414 bp, Homo sapiens
  Genbank Accession No. T98199
  unsure (1)..(414): n = a or c or g or t
ttttttntttttttttttaagctaagacctttattaaaattttgtcctctggccagtcgtggnggctcangcnataatcccaacactttgggagggcaaggtggaaggattgcttgancccaggnattcaagaccagcctgggaaacaaagggtagaccctgggnataaaaaattagctaggcgtggtggcacacctggtcggtctcagctactcaggaggctgaggtgggaggatcacttgagcccagggaggttgaggctgcagtacgtcacgcacacacccctaccagggaattatcagtctttntttgggatttccacancttcgaaagattttccccaactgttttntcagtgtcccacagtnccctaggatcttngaccctcaaattnaaggntttaaccaantgccc

SEQ ID NO: 3267 - DNA, 471 bp, Homo sapiens
  Genbank Accession No. T98284
  unsure (1)..(471): n = a or c or g or t
tccaggnggataaaggactgtgtggggaaagtaccaaataaatgaggtaaaaaggaagggtcatacaaagagggcactacaccagcttcttggcctcaaagaagctcttgaggtgacgcatctgccagatgccagtgaggatgaggatgacagtctgagcaatggaccaccataggaccctctggttggtgctctcgctcgtcagtcggaagcgctcttcacgatacctttgggtaatcctgctccttctgaatctgttccacctgatcaagcaactgggcggngcgcggactgttagctcccnccagctttatcttttgcaggcaatctcaggggtaggttnttgggcatgctccccaacctggggatntcgagattgcacacgcagtttttnccaccagcgaggagagccatnctgggtagnatttggagtncagacagnttttnatgggtcacccggccttttgggga

SEQ ID NO: 3268 - DNA, 287 bp, Homo sapiens
  Genbank Accession No. T98676
taacatttattgcttcttttggggttagcaagttgtaagcctcattagatgcatacactaagaaatggaattgattagactcgaccgtaggaatggatcaaactatgtactcttcttgttccaagtttcctccaaaagtagtagttattttgtttttcttcatccttgtacagatacatttagtagagcttaccacatagccttcccctaacaaattcccaaagacgtcccacagcccccttatggtaatgagggtccaatcaatgatcaattaggccatgctaggt

SEQ ID NO: 3269 - DNA, 520 bp, Homo sapiens
  Genbank Accession No. T99312
  unsure (1)..(520): n = a or c or g or t
gnnntttttatgttgtcattgctttattactcatagtttccaagcaatattacatatataaaagtcattttaaaaacaaccaggnttgctagaaaagtgttttttcttggaatcatggatttctacaccatttatacctggngtcctttatattaaatatattatttacgcaggcactaggcaaaattgaagaagttttgagttatctcctccataacccccaccttcccacattcccacaaaaaaatcccaccctttccctattatatgggggntattaacattaaaaacaangggggaaatacacaggggcatttcaatttggaatcacttttcccctattttttacatgtctggggaggagttggggcttggggntatgggnatttccaaagggttcctccccagggggttccttggatggatgggattcaagggggggnaatcctttccaatggctatccctctttccccagggnaatttccctgganggtccttaggggtttccgtggacagggg

SEQ ID NO: 3270 - DNA, 379 bp, Homo sapiens
  Genbank Accession No. T99636
  unsure (1)..(379): n = a or c or g or t
gctcggcgtggggtgtgtgttgatgctgagtttggccacgcatctccctgggttagagactgcacagtgtcctcgccctggactgccacggggactcggtaggctggagagcatcagggttcgtcacgaacaccatgaggtcaaagggcattcctggtttgaagtacttgggtgtcttggtgaagtggatctggtagggagaggtcacgatggggatcccgctgcgctctgcctgcaccatgtcactgcctgagtgcaagatgacggtggcagacacgtacaaagacttccccaccagggcttcttctcgggggttctncancccntccancagtacctttcggctcagcacaaccttccccgagccatnctnaatcgg

SEQ ID NO: 3271 - DNA, 3536 bp, Homo sapiens
  Genbank Accession No. U00115
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagaggcctgcagcagtaagaatgcctgcatcctccaggcttctggctcccctccagccaagagccccactgaccccaaagcctgcaactggaagaaatacaagttcatcgtgctcaacagcctcaaccagaatgccaaaccaggggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttcgctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaacaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacccaaagaacccaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgtgataactactccggagacagggtttggctgtgtctaaactgcattaccgcgttgtaaaaaatagctgtaccaatataagaataaaatgttggaaagtcgcaaaaaaaaaaaa

SEQ ID NO: 3272 - DNA, 8833 bp, Homo sapiens
  Genbank Accession No. U01062
cgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggtcccgttccgtgagaaggggggtgaaggtcccctggtgcggctggaggagctgtcagaccagaagaacgccccctaccagcacatgttccgcctgtgctaccgtgtgttgcggtattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccactggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcaccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctcgtgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagccggttgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctcgtcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaacgtccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgcggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatcta

SEQ ID NO: 3273 - DNA, 3095 bp, Homo sapiens
  Genbank Accession No. U01120
tagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggattctctttggacagcgtccatactggtgggttttggatactgactactacagcaacacttccgtgcccctgataaagcagttccctgtaacctgtgagactggaccagggagcccctctggccatgccatgggcacagcaggtgtatactacgtgatggtcacatctactctttccatctttcagggaaagataaagccgacctacagatttcggtgcttgaatgtcattttgtggttgggattctgggctgtgcagctgaatgtctgtctgtcacgaatctaccttgctgctcattttcctcatcaagttgttgctggagtcctgtcaggcattgctgttacagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgtttaaagtcaacaaccatgccagggattgaggaggactactatttgaagcaatgggcactggtatttggagcaagtgacatgccatccattctgccgtcgtggaattaaatcacggatggcagattggagggtcgcctggcttattcccatgtgtgactccagcctgccctcagcacagactctttcagatggaggtgccatatcacgtacaccatatgcaagtttcccgccaggaggtcctcctctctctacttgaatactctcacaagtagggagctcactcccactggaacagcccattttatctttgaatggtcttctgccagcccattttgaggccagaggtgctgtcagctcaggtggtcctcttttacaatcctaatcatattgggtaatgtttttgaaaagctaatgaagctattgagaaagacctgttgctagaagttgggttgttctggattttcccctgaagacttacttattcttccgtcacatatacaaaagcaagacttccaggtagggccagctcacaagcccaggctggagatcctaactgagaattttctacctgtgttcattcttaccgagaaaaggagaaaggagctctgaatctgataggaaaagaaggctgcctaaggaggagtttttagtatgtggcgtatcatgcaagtgctatgccaagccatgtctaaatggctttaattatatagtaatgcactctcagtaatgggggaccagcttaagtataattaatagatggttagtggggtaattctgcttctagtattttttttactgtgcatacatgttcatcgtatttccttggatttctgaatggctgcagtgacccagatattgcactaggtcaaaacattcaggtatagctgacatctcctctatcacattacatcatcctccttataagcccagctctgctttttccagattcttccactggctccacatccaccccactggatcttcagaaggctagagggcgactctggtggtgcttttgtatgtttcaattaggctctgaaatcttgggcaaaatgacaaggggagggccaggattcctctctcaggtcactccagtgttacttttaattcctagagggtaaatatgactcctttctctatcccaagccaaccaagagcacattcttaaaggaaaagtcaacatcttctctctttttttttttttttgagacagggtctcactatgttgcccaggctgctcttgaattcctgggctcaagcagtcctcccaccctaccacagcgtcccgcgtagctggcatacaggtgcaagccactatgtccagctagccaactcctccttgcctgcttttctttttttttctttttttgagacggcgcacctatcacccaggctggagtggagtggcacgatcttggctcactgcaacctcttcctcctggttcaagcgattctcatgtctcagcctcctcagtagctaggactaccggcgtgcaccaccatgccaggctaatttttatatttttagaattttagaagagatgggatttcatcatgttggccaggctggtctcgaactcctgacctcaagtgatccacctgccttggcctcccaaggtgctaggattacaggcatgagccaccgcaccgggccctccttgcctgtttttcaatctcatctgatatgcagagtatttctgccccacccacctaccccccaaaaaaagctgaagcctatttatttgaaagtccttgtttttgctactaattatatagtataccatacattatcattcaaaacaaccatcctgctcataacatctttgaaaagaaaaatatatatgtgcagtattttattaaagcaacattttatttaagaataaagtcttgttaattactatattttagatgcaatgtgatc

SEQ ID NO: 3274 - DNA, 5265 bp, Homo sapiens
  Genbank Accession No. U01147
ctcgcccctccgcgctcgcaacttcggcctcccccggctcccgcccgccctccctcctttgttgcgcgatgagggtcgggtttcggatctgaccgagccgccgccgcgggatggagccgctcagccaccggggcctgccgcgcctgtcctggatcgacaccctctacagcaacttcagctacgggacggacgagtacgacggagaggggaatgaggagcagaaggggcccccggagggctcagagaccatgccgtacatcgatgagtcgcccaccatgtccccgcagctcagcgcccgcagccagggccggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgtgccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgcctcttccttcccagcctgcctgcatgcatgtgcacccttggtcttcgctccatcgccttgaaagctctgaagaggccctgggttgtcgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgttccttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccaggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagccgtgctgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgcgaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgccagcagggtggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaactcaaaaaaaaaaaaaaaaaaaaaaa

SEQ ID NO: 3275 - DNA, 1969 bp, Homo sapiens
  Genbank Accession No. U01824
cagctgccgactccgctggacctgggacccccagacgtgggaggatgggggtgacctagtgtcttccagtagggcaatctctggacatctttatctccccagtacctctccagatcctgaagcctggggccagggaggagaggttagatgtcagcagtggaaggacagtgccaacaatatgcccaagcaggtggaagtgcgaatgcacgacagtcatcttggctcagaggaacccaagcaccggcacctgggcctgcgcctgtgtgacaagctggggaagaatctgctgctcaccctgcaggtgtttggtgtcatcctgggatcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaaaaaaaaaa

SEQ ID NO: 3276 - DNA, 2376 bp, Homo sapiens
  Genbank Accession No. U02020
cgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtgg

SEQ ID NO: 3277 - DNA, 2369 bp, Homo sapiens
  Genbank Accession No. U02388
ctcggatcagtctggcagagagaggaggttgtctgggacagactgctcctgacagaaggatgtcccagctgagcctgtcctggctgggcctctgccgagtggcagcatccccttggctgctcctcctgctggtcggggcctcctggctcctggcccatgtcctggcctggacctacgccttctatgacaactgccgccgccttcggtgtttcccacaacccccaagacggaactggttttggggacaccagggcatggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggccatgacaccacggccagtgtcctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcgcgtgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatactgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacatt

SEQ ID NO: 3278 - DNA, 2593 bp, Homo sapiens
  Genbank Accession No. U02493
agataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcacgaagaagaaatgatgcggcgacacgaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggtctcccaaaatgctgggattacaggggtgagccaccgtgcccaacctcacttgcttcttatccttacactcccccagccccagagaaactgccacatacaccacaaaaaccaaacatgccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaaatcttgtgttaacttgcctccatctttttcttggggtgagggacaccagggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacttttaagcctttt

SEQ ID NO: 3279 - DNA, 2517 bp, Homo sapiens
  Genbank Accession No. U03056
ttcctccaggagtctctggtgcagctggggtggaatctggccaggccctgcttaggcccccatcctggggtcaggaaatttggaggataaggcccttcagccccaaggtcagcagggacgagcgggcagactggcgggtgtacaggagggctgggttgacctgtccttggtcactgaggccattggatcttcctccagtggctgccaggatttctggtggaagagacaggaaggcctcccccccttggtcgggtcagcctgggggctgagggcctggctgtcagccactcttcccagaacatatgtcatggcctcagtggctcatggggaagcaggggtgggcgagcttaggctagagcaagtcctgtgggagatggcagaggcctggtctgagaggcaactcggatgtgccctccagtggccatgctcccctccatgcgtctcccctgccctcctggagccctgcaggtcaatgtttaacagaaaccagagcagcggtggattaatgcgcaagggctcagccccccagccctgagcagtgggggaatcggagactttgcaacctgttctcagctctgcctcccctggccaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttactt

SEQ ID NO: 3280 - DNA, 2061 bp, Homo sapiens
  Genbank Accession No. U03105
tgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaaccctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacaga

SEQ ID NO: 3281 - DNA, 1619 bp, Homo sapiens
  Genbank Accession No. U03398
gtcatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataacgcccagcctgggtgcagcccacctggacagagtccgaatcctactccatccttcatggagacccctggtgctgggtccctgctgctttctctacctcaaggggcttggcaggggtccctgctgctgacctccccttgaggaccctcctcacccactccttccccaagttggaccttgatatttattctgagcctgagctcagataatatattatatatattatatatatatatatatttctatttaaagaggatcctgagtttgtgaatggacttttttagaggagttgttttggggggggggtcttcgacattgccgaggctggtcttgaactcctggacttagacgatcctcctgcctcagcctcccaagcaactgggattcatcctttctattaattcattgtacttatttgcctatttgtgtgtattgagcatctgtaatgtgccagcattgtgcccaggctagggggctatagaaacatctagaaatagactgaaagaaaatctgagttatggtaatacgtgaggaatttaaagactcatccccagcctccacctcctgtgtgatacttgggggctagcttttttctttctttcttttttttgagatggtcttgttctgtcaaccaggctagaatgcagcggtgcaatcatgagtcaatgcagcctccagcctcgacctcccgaggctcaggtgatcctcccatctcagcctctcgagtagctgggaccacagttgtgtgccaccacacttggctaactttttaatttttttgcggagacggtattgctatgttgccaaggttgtttacatgccagtacaatttataataaacactcatttttcc

SEQ ID NO: 3282 - DNA, 1348 bp, Homo sapiens
  Genbank Accession No. U03891
  unsure (1)..(1348): n = a or c or g or t
ggatcttaacaccacgccttgagcaagtcgcaagagcgggaggacacagaccaggaaccgagaagggacaagcacatggaagccagcccagcatccgggcccagacacttgatggatccacacatattcacttccaactttaacaatggcattggaaggcataagacctacctgtgctacgaagtggagcgcctggacaatggcacctcggtcaagatggaccagcacaggggctttctacacaaccaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgaatttaagcactgctgggacacctttgtggaccaccagggatgtcccttccagccctgggatggactagatgagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggctgcacgcctgtaatcccagcactttggaggccaaggcgggtggatcacgaggtcaggagatcgagaccatcctggctaacacggtgaaaccctgtctctactaaaaatacaaaaaattagccaggggtggtgcgggcgcctgtagtcccagctactctggaggctgaggcaggagagtacgtgaacccgggaggcagagcttgcggtgagccgagattgcgctactgcactccagcctgggcgacagnaccagactccatctcaaaaaaaaaaaaaaccagactgaattaattttaactgaaaatttctcttatgttccaaggtacacaataggtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacact

SEQ ID NO: 3283 - DNA, 2566 bp, Homo sapiens
  Genbank Accession No. U04313
ggcacgagttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatataccctttggatttcaaacagtaacatcggatgtaaacaaacttagttccttttactcactgaaactaatcaagcggctctacgtagacaaatctctgaatctttctacagagttcatcagctctacgaagagaccctatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaatttcctgaatcagaaacaaaagaatgtcctttcagactcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagacctttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaacctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatgtggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttgggtggataagctatccctgttgccggttcatggattacttctctataaaaaatatatatttaccaaaaaattttgtgacattccttctcccatctcttccttgacatgcattgtaaataggttcttcttgttctgagattcaatattgaatttctcctatgctattgacaataaaatattattgaactacc

SEQ ID NO: 3284 - DNA, 541 bp, Homo sapiens
  Genbank Accession No. U05861
tagagcagtcagaaaatgaacttcttaacatctacactagcggcagcttcctagaaatcactgcactacccgctagtaacggagtcattgccattcagagtgtgcatttttttttctctttccagttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctactttcgtctccataacttctatgttttctttccttctgacacactagtgcccctaaattgtgatttgcctatacgtttagggccggggttggaagatgttaacaaccatttaagattcatttctgcagtgggagtgggtggagtttcag

SEQ ID NO: 3285 - DNA, 2214 bp, Homo sapiens
  Genbank Accession No. U05875
gttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccgagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagcttttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacactgagtggcccttcatgtacatccatggtgtgctggcttaaaatgtaattaatcttgtaaatatactcctagtaatttaagattttgtttttaaactggaaataaaagattgtatagtgcatgtttttt

SEQ ID NO: 3286 - DNA, 2123 bp, Homo sapiens
  Genbank Accession No. U06641
gtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaattatttggaagattctcttctgaaaattctcgatagatggatatatggtgtttcaaaaaatacattttggtcatatttttcacaattacaagaattgtgttgggcatattatgactacagtaacaagctctgtaaagatgcagttttgaataagaaacttatgatgaaactacaagagtcaagatttgatgtcattcctggagatcctgttttcccctgtggtgagctactgtcagagctacttaacataccctttgtctacaggtctcgcatctctcgtggctacacaattgagaagaatggtggaggatttctgttccctccttcctatgtacctgttgttatgtcagaattaattgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaattggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaagatgataacattgctcacatgaaagccaagggagcagccctcagtgtggacatcaggaccatgtcaagtagagatttgctcaatgcattgaagtcagtcattaatgacccagtctataaagagaatgctatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgggtggcaactgtgatatttatcatcacaaaattttgcctgttttgtttccgaaagcttgccaaaaaaggaaagaagaagaaaagagattagttatatcaaaagcctgaagtggaatgactgaaagatgggactcctcctttatttcagcatggagggtttaaatggaggatctccttttcctgtgacaaaacatctttcacaacttaccttgttaagacaattttaaaaaagatcttttcacaacttaccttgttaagacaaaatttattttccaggctatttaatacgtactttagctggaattattctatgtcaatgatttttaagctatgaaaatacaatgggggaaggatagccatttggagatataacctaatgttaagtgacgagttactggatgcagcacccgaacatggcacatgtatacatatgtagctaacccttcgttgtgcacatgtaccctaaaacttaaagtataatttaaaaaaagcaaaaaaaaaatacaactcttttttttttaaaccaggaaggaaaatgtgaacatggaacaacttctagtattggatctgaaaataaagtgtcatccaagccataaaaaaaaaagaaaagaaaaataaaaataatataaaaccttaaaaaaa

SEQ ID NO: 3287 - DNA, 1987 bp, Homo sapiens
  Genbank Accession No. U06863
gggcggggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacactttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatccttgctcccc

SEQ ID NO: 3288 - DNA, 3345 bp, Homo sapiens
  Genbank Accession No. U07969
gaattccgtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccatagaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttaagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagactttgaggagagggcgtatgtcgtcttgatccgcatcaatgatgggggtcggccacccttggaaggcattgtttctttaccagttacattctgcagttgtgtggaaggaagttgtttccggccagcaggtcaccagactgggatacccactgtgggcatggcagttggtatactgctgaccacccttctggtgattggtataattttagcagttgtgtttatccgcataaagaaggataaaggcaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcacccaccaccatgcccagctaatttttgtatttttaatagagacggggtttcgccatttggccaggctggtcttgaactcctgacgtcaagtgatctgcctgccttggtctcccaatacaggcatgaaccactgcacccacctacttagatatttcatgtgctatagacattagagagatttttcatttttccatgacatttttcctctctgcaaatggcttagctacttgtgtttttcccttttggggcaagacagactcattaaatattctgtacattttttctttatcaaggagatatatcagtgttgtctcatagaactgcctggattccatttatgttttttctgattccatcctgtgtccccttcatccttgactcctttggtatttcactgaatttcaaacatttgtcagagaagaaaaaagtgaggactcaggaaaaataaataaataaaagaacagccttttgcggccgcgaattc

SEQ ID NO: 3289 - DNA, 820 bp, Homo sapiens
  Genbank Accession No. U08006
tcgaccagaggaggggaggccagttcctctcccaagggtgccacacacccctccctgttcatcaccagacaggcccttccttcttagccatatgctaaccttctcctccctgggaaatttcctctgcaggagccaaagcagatgggagctggagttgctggagctcctggtctgtatgcagagcaggcatccaggaaaggagaagagagtgtgacaatccagcacctcagaatggaggggcctcgtgttcagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttcaaattgcctcattgacctgttatatcataactct

SEQ ID NO: 3290 - DNA, 952 bp, Homo sapiens
  Genbank Accession No. U08021
tgaactctggatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtca

SEQ ID NO: 3291 - DNA, 2344 bp, Homo sapiens
  Genbank Accession No. U08198
agcgggcggcggtcgtgggcggggttgcaggcgaggctcaacgaacgctggtctgaccgtcggcgctccctgttgccgggccctgagcaagtggcttcatgaaccccgtgacgttggccatggagataagaccactgggtgatggtttaaggaagataacgtgtaaagggctaaggactgtcggtggaaatcaggggtgcaggagaaatggataaacagccagaggtcaactcggactttgtacataggacatggtgccaggccctgccaggaagtgcagatcgaagctaggctcacgaggaggctggaggtggggggtggggaggcaacggatggacatggacttcctgggctgggctctgtgacagcagagtagactctgtcctgggacttggtggtgctacccttggcctcccacagtcctgccaccctgctgccgccaccatgctgccccctgggactgcgaccctcttgactctgctcctggcagctggctcgctgggccagaagcctcagaggccacgccggcccgcatcccccatcagcaccatccagcccaaggccaattttgatgcgcagcaggtagaagttggggggggtagagggaggcaggtagaagttgtgggaggggtagagggagacaggtagaagttgttgcgggggagagggaagcaggtgaagttgtggggggtgtagagggaagcaggtgaggggccctcccacagtgccctcgagttctcccatggtctgcccccagtttgcagggacctggctccttgtggctgtgggctccgcttgccgtttcctgcaggagcagggccaccgggccgaggccaccacactgcatgtggctccccagggcacagccatggctgtcagtaccttccgaaagctgtgagtcccagagcagccctgcaccctaaccccaaccctcctctcagcccccggacttcagccctgctctggcccctgaccccaccccggctgtggcctggactaggattcctggttggggtctcccagcctgtggtgcctcctccccgcccccccagggatgggatctgctggcaggtgcgccagctctatggagacacaggggtcctcggccgcttcctgcttcaaggtgaggcaggggctgcaggtcatgtgggtgggggatgacgcagccactgtggctctctgacatggctactgtggctctgcccagcccgaggcgcccgaggggctgtgcacgtggttgtcgctgagaccgactaccagagtttcgctgtcctgtacctggagcgggcggggcagctgtcagtgaagctctacggtatgtgggggccagcctctgtgaccaggcaggcgctcaagctctgcacactcactgggccaccccgaggggctgggtgagccatggggacacacttcctttctcccatcctgatcctcctgctaagcaggggcccagggagtagtgacagacaggcctggtgtgggagcagggaggagggccccgaggggcaggggacacacagaccccgttcccagagccctccacgccgcctggtgccaggaccccaggaaccctgtctgccctgcagcccgctcgctccctgtgagcgactcggtcctgagtgggtttgagcagcgggtccaggaggcccacctgactgaggaccagatcttctacttccccaagtacggtgagtgtccccagcaggtccccagctcagccacccccactctctggctgatgtccagcctgacccctgccttggcgccccaggcttctgcgaggctgcagaccagttccacgtcctggacggtgagtgcacagcgggggcaagcatggcggcgtggtgaggggggccactcgcaccggctgagtctcgtctctgctgcagaagtgaggaggtgaggccggcacacagctccagtgctgagaagtcagtgccccgagagacgaccccaccagtggggtgcccgctgcctgtcctccgtgaaaccagcctcagatcagggccctgccacccagggcaggggatcttctgccggctgccccagaggacagtgggtggagtggtacctacttattaaatgtctcagacccctctctgactcttctgtccactctggaccggcgccagtaccaccaaggccctctctgcccccaccccgcctctttaaaagcccggcgctccctgttggctggagtccacgcagggtcactgggccgatttcggctcttgggatttgggaggggagatcctctctggcatatgccatcttgtgccctgctggacctgggggcgtccacgtcactccaaggctgctcttgcctgggccatgcctgcagccc

SEQ ID NO: 3292 - DNA, 2090 bp, Homo sapiens
  Genbank Accession No. U08854
ttcggcacgagtaagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaatgatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatacattaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatgtcatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgcgtggcaactgtgatatttatcatcacaaaattttgcctgttttgtttccgaaagcttgccaaaacaggaaagaagaagaaaagagattagttatatcaaaagcctgaagtggaatgactgaaagatgggactcctcctttatttcagcatggagggttttaaatggaggatttcctttttcctgtgacaaaacatcttttcacaacttaccttgttaagacaaaatttattttccagggatttaatacgtactttagttggaattattctatgtcaatgatttttaagctatgaaaaatacaatggggggaaggatagcatttggagatatacctaatgttaaatgacgagttactggatgcagcacgcaacatggcacatgtgtatacatatgtagctaacccttcgttgtgcacatgtaccctaaaacttaaagtataatttaaaaaaagcaaaaaaaaaaaataccaactcttttttttaaaccaggaaggaaaatgtgaacatggaaacaacttctagtattggatctgaaaataaagtgtcatccaagccataaaaaaaaa

SEQ ID NO: 3293 - DNA, 2627 bp, Homo sapiens
  Genbank Accession No. U09117
ttctggtcgcactccgctcggaccccaggccgccggtgctgtcgctactcaagtgagtcccgcggtgcccctcccgccgcgccgcccgacgggcatggactcgggccgggacttcctgaccctgcacggcctacaggatgatgaggatctacaggcgctgctgaagggcagccagctcctgaaggtgaagtccagctcatggaggagagagcggttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccaggtggacgacagctatgcccggaagatcttcagggagtgtgaccactcccagacagactccctggaggacgaggagattgaggccttctacaagatgctgacccagcgggtggagatcgaccgcaccttcgccgaggccgcgggcccaggggagactctgtcggtggatcagttagtgacgttcctgcagcaccagcagcgggaggaggcggcagggcctgcgctggccctctccctcattgagcgctacgagcccagcgagactaccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccgggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgagcaactgaaggggaagatcctgctgaaggggaagaagctcggggggctcctcccccctggaggggagggtggccctgaggccactgtggtgtcagacgaagacgaggctgctgagatggaggatgaggcagtgaggagccgtgtgcagcacaagcccaaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggaaacggctttgtccgccacaacgtggggcacctgagcagaatatacccggctggatggagaacagactcctccaactacagccccgtggagatgtggaatgggggctgccagatcgtggccctgaatttccagacacctgggccagagatggacgtgtaccaggaccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaacccagtggggtcccccctgagtgggctgggccctctgtccacatgtggggacagggctggtgtgcctgctcccagcctcttgctcagagctaggcccccaaattgccttcagccctaacatagtgtctgctgctgcctccctggggaccaggagctagcccagtccctggagctgtccttcattccgttaggaataacaatgcagccctctccaccctccggccagcgagtggtcaaggatttttataaaaa

SEQ ID NO: 3294 - DNA, 4326 bp, Homo sapiens
  Genbank Accession No. U09564
atataaaatagtattccaaataagtacattttatagcaaaattatgcatttttcctaagactttcatcaccaatatcgccttataccctgcttttgttgggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagtctcccaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtctcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataaccta

SEQ ID NO: 3295 - DNA, 416 bp, Homo sapiens
  Genbank Accession No. U09770
agagtctcgcactgtagcccgtgccgccccagccgctgccgcctgcaccggacccggagccgccatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgtagccatgtttgggcctaaaggctttgggcggggcggagccgagagccacactttcaagtaaaccaggtggtggagacccatccttggctgcttgcaggccactgtccaggcaaattccaggccttgtcccagatgccaggatcccttgttgcctaatgctctagtaacctgacattgga

SEQ ID NO: 3296 - DNA, 1052 bp, Homo sapiens
  Genbank Accession No. U11313
aatgaattttctttcttcttcacaggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacatcggcaaatagcgtggataggatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcctctcttgtttttactgtgtatgtt

SEQ ID NO: 3297 - DNA, 992 bp, Homo sapiens
  Genbank Accession No. U11861
gaattccctgaggcgggagaccggtggtctgcaccgtcctggagggagatatgagtggctggactctcagccagccactgggatgtgttcgggctttggaccttgaggccggagagagctcccgagaggaggcggcgcacgttcgttcttctgaggggacggtagatttgggggtttttcctctaggattctcgcgccgtttcctctgaagaaacagaaccagagagggaaggtgacctgaaagtcactgaataatttttttagagctgaacaagaatccaagcctgcaactgcaactgcagagacgagagatctttctgctgtctatactcttggaaagcacatcctaagatctttgcagattatctgtggaaggagaatgcctaaagtcaaacgaagccggaaagcaccccaggatggctgggagttgattgagccaacactggatcaattagatcaaaagatgagagaagctgaaacagaaccgcatgagggaaagaggaaagtggaatctctgtggcccatcttcaggatccaccaccagaaaacccgctacatcttcgacctcttttacaagcggaaagcctacagcagagaactcttagatatatgttataaagaaggcttagcagacaaaaacctgttggcaaaatggaaaaagcaaggtataggaaacttgtgctgcctgcggtgcattcagacacgggacaccaacttcgggacgaactgcatctgccgcgtgcccaaaagcaagctggaagtgggccgcatcatcgagtgcacacactgtggctgccgtggctgctctggctgacggtggctgctgctccaccctggactctggacttcgcaggttccttgcctgtcacgccacccccttcctgggagcagcgagcagtgccccaggcccgagttggagcacggtctctatggggaagcgttcgctgtctatcagctgtgatttgtaaaaataaaatctttaaatctctcga

SEQ ID NO: 3298 - DNA, 700 bp, Homo sapiens
  Genbank Accession No. U12404
gcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggtcaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttc

SEQ ID NO: 3299 - DNA, 433 bp, Homo sapiens
  Genbank Accession No. U12465
ccacgcgtccgggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgag

SEQ ID NO: 3300 - DNA, 2682 bp, Homo sapiens
  Genbank Accession No. U12778
attcctgcgccgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcttttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcatgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccggtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccatgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccgtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatatctgtcatgcactattttcagttgacaatttctgtattttaattgaatactgtttcttcagtcatggttattattgcactttatcctgaataatagttcagaaattgggttttggttcagtgattctcaagaaaaagatctcttgcccattaagaagtgtatcaaaatctcataaggaatgagggagagaagggggctgtacagtttgaaaaagcatattcaatattaaaatagttttatatttgggaaggcaaaaatgaatctattgttttgcaatataggttatacaggaaaatgcaataaaatatatatctggttgt

SEQ ID NO: 3301 - DNA, 1232 bp, Homo sapiens
  Genbank Accession No. U13061
ctgctatgttagctacaatgtccatgtcaggtgcctggtggagacaggtcaaggagatgtgtggtctgacctgagtttctgcttcttgtttccaggtgtatctggggactggaaaaatcacttcacagtggcccaagctgaagactttgataaattgttccaagagaagatggcagatcttcctcgagagctgttcccatgggaataacgtccaaaacactctggatcttatatggagaatgacattgattctcctgtccttgtacatgtacctgactggggtcattgtgtaagacttattattttatcctgaaaccttaaatatcaaacctctgcatctctgatcccttccttgttaaaagttaccacggttggccaggcgcggtggttcatgcctgtaatcccagcactatgggaggccgagacgggcggatcacgaggtcaggagactgagaccatcctggctaacacggtgaaaccccatctctactaaaaatacaaaaaccaaaaaaaattagccaggcgcattggctcagtgtctgtaatcccagcactttgggaggtcgggggggtgggggaggatcacggggtcaggagatcgagaccatcctggccaacatgatgaaaccctatctctactaaaaatacaaaaattagccgggcatggtggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttcagagaaccagggttcaaagcccagggatgcaaaggttgcagtgagttgagtcatgggatcccagacttttttaaatgtttgcaatgtttcccgtttacagaatgctacaagaataatgtacgtactacctaaaaggatgtctaaatgtttgttaataaaaataagaaatagctacagtgacagattttagagcaaaaattagtaataaaaataagaaataaaattacaggagcaattaaggttccatttcttttcatcacatgtatctccacaatttattattgctctgatcttaaggagtgtaatttgcaatctaattttatcctcttactctgtgttgttaaaccatatacaataaacggtgtttatggaggcttctaaaactttcataaggccaggtgcggtgg

SEQ ID NO: 3302 - DNA, 507 bp, Homo sapiens
  Genbank Accession No. U14968
cgtctgggctgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagcacatggagggagtttcattaaatgctaactacttttaaaaa

SEQ ID NO: 3303 - DNA, 485 bp, Homo sapiens
  Genbank Accession No. U14969
gtcgccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcacgcagaagcctgtgatggtgaagaggaagcggacccgccccaccaagagctcctgagccccctgcccccagagcaataaagtcagctggctttctcaaaa

SEQ ID NO: 3304 - DNA, 705 bp, Homo sapiens
  Genbank Accession No. U14970
cgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctccctcacagtgcagggcggtatgccgcaaacgctttccgcaaagctcagtgtcccattgtggagcgcctcactaactccatgatgatgcacggccgcaacaacggcaagaagctcatgactgtgcgcatcgtcaagcatgccttcgagatcatacacctgctcacgggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttccagctgctgcccaataaacctgtctgccctttgggatcccagccaaaa

SEQ ID NO: 3305 - DNA, 692 bp, Homo sapiens
  Genbank Accession No. U14971
cccgcgcaggcgcagacggtggaagcggacgcaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgattgggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacattgacttctctctgcgctctcctacgggggttggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttaaaa

SEQ ID NO: 3306 - DNA, 570 bp, Homo sapiens
  Genbank Accession No. U14972
gcctgcagccgcagagatgttgatgcctaagaagaaccggattgccatctatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaa

SEQ ID NO: 3307 - DNA, 268 bp, Homo sapiens
  Genbank Accession No. U14973
tttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtata

SEQ ID NO: 3308 - DNA, 479 bp, Homo sapiens
  Genbank Accession No. U15008
cgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttct

SEQ ID NO: 3309 - DNA, 789 bp, Homo sapiens
  Genbank Accession No. U15174
gccaccgcccgcagctgaagcacatccgcagcccggcgcgactccgatcgccgcagttgccctctggcgccatgtccgagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagggcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctgggccttcgtggctcgagagactagaatcgcagatacgaaaaccccgcagc

SEQ ID NO: 3310 - DNA, 2470 bp, Homo sapiens
  Genbank Accession No. U15932
aatcgcgaaacccggcgagcggcgcgctggctatcgagcgagcggggcggaaccgggagttgcgccgccgctcgggcgccgggctccgtcgcggccgcagccccgcgggtcgccctcccgtgcctcgcccgcggacaccctggccgtggacaccctggccgtgggcacccgcggggcgcggcgcgggcgctgcgcggcggcggcggcggcatgaaggtcacgtcgctcgacggcggccacgtgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcgcggcgcgcgcggctcctgcaggagggcggcggcggcgtcgcggccgtggtggtgctggaccagggcagccgccactggcagaagctgcgagaggagagcgcgtttgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacttgcacatcacagccctgctgaatgtctcccgacggacctccgaggcctgcatgacccacctacactacaaatggatccctgtggaagacagccacacggctgacattagctcccactttcaagaagcaatagacttcattgactgtgtcagggaaaagggaggaaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggcccaatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataagccaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtcaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaactgtggacttctgggatttgcagattttgcaacgtggtactacttttttttctttttgtctgttagttatttctccaggggaaaaggcaataattttctaagacccgtgtgaatgtgaagaaaagcagtatgttactggttgttgttgttgttcttgttttttatatgtaaaataaaaatagtgaaaggag

SEQ ID NO: 3311 - DNA, 11185 bp, Homo sapiens
  Genbank Accession No. U16306
gctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcaactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccagg

SEQ ID NO: 3312 - DNA, 1196 bp, Homo sapiens
  Genbank Accession No. U16660
ggaactcagtagacgaaggcggcggcgatggcggcggggatagtggcttctcgcagactccgcgacctactgacccggcgactgacaggctccaactacccgggactcagtattagccttcgcctcactggctcctctgcacaagaggaggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactggagcgcctgcccaaggtcatcgggaaccagagcctggtcaacgagctggccttcaccgcccacaagatgatggctgacgaggccctggacagtgggctggtcagccgggtgttcccagacaaagaggtcatgctggatgctgccttacccctggcgcccgagatttccagcaagaccaccgtgttggtgcagagcaccaaggtcaacctgctgtattcccgcgaccattcggtggccgagagcctcaactacgtggcgtcctggaacatgagcatgctgcagacccaagacctcgtgaagtcggtccagcccacgactgagaacaaggaactgaaaaccgtcaccttctccaagctctgagagccctcgcgtcccagccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaa

SEQ ID NO: 3313 - DNA, 2280 bp, Homo sapiens
  Genbank Accession No. U17077
ccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttttgcaacctgataccttgaaaagcttctatgtgtctctccttttgttgcctggcagctgtctaggatgatcactgattactatttactaagtagccacatgcaaataaaagttgtttggtaaaatggaaaaaaaaaaa

SEQ ID NO: 3314 - DNA, 577 bp, Homo sapiens
  Genbank Accession No. U17760
caccactgctttagaggccagatttttctggaggggattcctctacacatgctacctccagttagcaggaggggaaggaagggttgggagtcttggggagtctcaccatcaactcctcctcctgctgctgttccatttgcctcagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttggggggcagattgggttggaatgctttccatctccaggagactttcatgtagcccaaagtacagcctggaccacccctggtgtgtacctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccac

SEQ ID NO: 3315 - DNA, 3875 bp, Homo sapiens
  Genbank Accession No. U17989
ggggaagggcagatggaggagggattgtaatggcggcagccggcagctccctgctctgacccacggcaggcacacagcaacgaccccttccccgcccctctcccggccggcctccgccccgcagccagcgcggggccaccctctccggcccttcccccagctgtcggcgtctcgccctgcgccccggccggggccccacacacaatggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagaacactatcccggggatactgcactacatccagcacgagtgggctcggttcgagatggagcgggcgcactgggaggtggaacgggccgaactgcaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtccggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggagtcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagttttttttttctcttcttcttcttcttttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtattcacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaatttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgta

SEQ ID NO: 3316 - DNA, 2333 bp, Homo sapiens
  Genbank Accession No. U18018
acaactgtctgctgcgcccgaaaaacaagtcggtgcgctggggacccggggccggggccgccttactccggcctagccccgcggccctcggtgcgggctccagggcatgctcggtaccccccgcggctccagcccagacgccccggcctcaggtctcggcccccgcttggggccccggccgtgcggcgcgagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 3317 - DNA, 1648 bp, Homo sapiens
  Genbank Accession No. U18321
gccttttttgcagtctcaggacgggcgctttggagccggccccaggcagcgtgtgtcggtcgcctagtctggagaactagtcctcgactcacggtgagggaatggaccgacacgggtattgtaccgctgagggaaaggagcgggactccggacctccaggagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactatacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggatgacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttct

SEQ ID NO: 3318 - DNA, 2244 bp, Homo sapiens
  Genbank Accession No. U19495
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctctcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagtaagcacaacagccaaaaaggactttccgctagacccactcgaggaaaactaaaaccttgtgagagatgaaagggcaaagacgtgggggagggggccttaaccatgaggaccaggtgtgtgtgtggggtgggcacattgatctgggatcgggcctgaggtttgccagcatttagaccctgcatttatagcatacggtatgatattgcagcttatattcatccatgccctgtacctgtgcacgttggaatttttattactggggtttttctaagaaagaaattgtattatcaacagcattttcaagcagttagttccttcatgatcatcacaatcatcatcattctcattctcattttttaaatcaacgagtacttcaagatctgaatttggcttgtttggagcatctcctctgctcccctggggagtctgggcacagtcaggtggtggcttaacagggagctggaaaaagtgtcctttcttcagacactgaggctcccgcagcagcgcccctcccaagaggaaggcctctgtggcactcagataccgactggggctgggcgccgccactgccttcacctcctctttcaacctcagtgattggctctgtgggctccatgtagaagccactattactgggactgtgctcagagacccctctcccagctattcctactctctccccgactccgagagcatgcattaatcttgcttctgcttctcatttctgtagcctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggta

SEQ ID NO: 3319 - DNA, 2921 bp, Homo sapiens
  Genbank Accession No. U19523
ccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagcctctactttcttcttgccacctttttgtggcaatattaaagtgaactgctaatagtgtaagtatgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttaaaaaaaaaaaaaaaaaaaaa

SEQ ID NO: 3320 - DNA, 8447 bp, Homo sapiens
  Genbank Accession No. U20499
acctctgcctcctggttccaagcaatcctccttcctcaccctccagagtagctgggattacacgcgcctgccaccgcgcctggcctaatttttgtatttttagtagagatgggggtttccaaccatgttggccaggctggtctccaaactcctgacctcaggtgatcctgcccacctaagcctcccaaaatgctggtattacaggcatgagccaccgtgcccggcctaaataattaataaaataatggacgatgggtgccttctactgagctcccggtaattgtgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttggtgagtgcagtcccctggccccagcctggtccacctctgggaagagggtgcccagttgtgcaatccaggcccaggcagctgagccctcatctcagcatgcagggcggatactggagggggcttgtggcatctgactctgtatctcctacctgcccctctccttggtagctgtgagaagtcactgctttggggagacctgatctggctgtgccagatggacactgagaaagaagtagaagactcagaattagaagaggtgagtgggctttggtggcgggctccctaccccactccctgccctgggctgcctgtgaccacactgcttgcctctgcaggcacactggacagacctgctggagacctgatcctcagtgtccttaccccctcctacctcttttctgtgccacctgctgtgggtccagcaggtttttacttgagtacaataaaaagtctgagtcaagggtgccttatggtggatgctgaggggaggggcggagctagtagcccaaggtcctgccagtcacggggcttcctcaggggcacagaggaggcaggaggggcccctggccctagcacgtgaacagcttctactctgcctggaaaccccatgcctcagctttcccctacttgcctctgagctcatgcaattcttggaagcctgggagacttaccttgaaattgaatgcaaataggacaaagaccaaggaggatggggggatgccctccttccacggggccctgtggcttccaagtcttaatctcctctagtctcttgtctacggagcctccttcaaacccagggaaagaaaagcacctgccagggttgtttttcttctaggatcttctattgatgctctgtgaggtcccccaggagccatgaagctagggctggctcctagggcaatgggactacagtgtccttgtcctttcttattctttctgttctttctttctttcttttttttttttttttttttttttgagacagagtctcactctgttgcccaggctggagtgcagtggtgtgatcttggctcactgaaacctccgcctcctgggttcaagtgattctcttgcctcagcctcctgagtagctaggattacaggtgcccgccatcatgcccagctaatttttgtatttttagtagagacagggtttcaccatgttggccagcttggtctcgaactcctgacctcaggtgatcctgctgcatcgacctcccaaagtactgggattacaggcgtgagccaccacgctcagcctctttcttgttctatatgtccatgctctgctccacttctgccccttcactctgccccacacatcactccagactggccttgtggtcagagcctggaatgcctgggctgctgggggcctgtggactgcactgggccagaacccctgccgccttcaagactggcctgtagccagcaggtaggtgacttttcccaggccggcctatcccacctttcccctccactcactcacctcccttgcctgggtcaattagagaaagcttgtcggccaggcatggtggctcatgcctgtaatctcagcactttgggaggccgaggcgggcggatcatctgagctcaggagtttgagaccagcctggccaacatggcaaaaccccgtctctactaaaaatacaaaaattaaccggatgtggtggtgtgcacctgtaatcccagctactcgggaggctgaggcagaagaatcgcttgaacccaggagggggaggttacagtgagcggagatcgtgctactgcattgcagcctgggcgagagagcgagtctccatctcacataaaaaaaagaaaaagaaagaaagcaagcttgtctgttggcctgccctgcagggtggagttcagagggaaggtcaggagcctagtgacagctcaaaaaaaaaaaaacccaaataccaatgttggccccttttgcctttcattcatgtgttttctatacactaaactcacatattgggtttgcagatcactccaagcttggctggagctgtggtggtaaggagggtaatagagaagcttccccaccctcaaccccaccccttccttcctggagttcccagccctgactttagatccctcccacactggaccttcaaaaccctcagggcagagagcagccctacactccctacaccacacccatactcagcccctgcaggcaaggagagaacaggtcaggttcccgagagctcaggtgagtgacacgttggaatggcccagggcaccttcaccctgctcagcttgtggctccaacattctagaagccgaggcctctgccatccctgccctttcccatggatattccatttcaattagacaacccagcctggccggaatccccctgcgttccttcttttcctttgtgtatttttgagacagggtgttgctccgtcacccaggctggagtgtagtgggatcctggcccactgcagcctcaaattcctaggctgaggcaatcctgccgcctcagcctcctgagtagctggggttacaagagcaagccaccacacccagctaattttgaaaaatattttttgtagaggagaggtcttgctttgttgtccaggttggtctcaaactccagggctcaagggatcctttcccgttggcctcccaaggctctgggattacaggcgggagtcaccctgcctgggcccctccttttgatgagtcatcagttttcattcccgcacgaggctctagcccctggtaccagcttagttgctcaatgggctgtgtttgttctggagcccagatggactgtggccaggcaagtggatcacagacctggccggcctgggaggtttccacatgtgaggggcatgaggggggctcaaggaggggagcatcggggagaggagcgcactgggtggaggctgggggtcccagcaggaaatggtgagacaaagggcgctggctggcagggagacagcacaggcaggccctagagcttcctcagcacagctggactctcctggagaccttcacacaccctgatatctgggccccgcgctacgagggtgctttcactggtctgcactatgccccaggccctgggattttgaacagctctgcaggtgactgaaaggtgcggccaggctggggaacgacctggtttcagccccagccccgccactgactgactttgtgagtgcgggcaagtcactcagcctccctaggcctcagtgacttccctgaaagcaaaaactctgcaaaggggcagctgggtgctggctcacacctgtaatcccagcactttgggaggctgaggtagacaaatcacttgaggccaggagttctagaccagcctggccaacatggtgaaaccccatctctactaaagaaaaaaaaaaattagctgagcatggttgtacatgcttgtaatcccagctacttgggatgccgaggcgggaggattgcttgaacccaagaggtggagtttgcagtgagctgagattgtgccacactgcactccagcttgggtgagagtgagactccatctcaaaaaaaaaaaaaaaaagagagaatcccactttcttgctgttgtgatggtggtaagggaacgggcctggctctggcccctgatgcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggtaagtgaggagggccacccaccctctcccaggcggcagtccccaccttggtcagcaaggtcgtgccctcagcctgctcacctcctatctccctccctctccaggcaccacctgggtgagccagatactggacatgatctaccagggcggcgacctagagaagtgtaaccgggctcccatctacgtacgggtgcccttccttgaggtcaatgatccaggggaaccctcaggtgcatggctgggtcctgggggtaagggaagtggaggaagacagggctggggcttcagctcaccagaccttccctgacccactactcagggctggagactctgaaagacacaccgcccccacggctcatcaagtcacacctgcccctggctctgctccctcagactctgttggatcagaaggtcaaggtgaggccggcctcaatggttcacacctgtcatcccagtttgagactgaggagggaggatcccttgaaggcgagagatggagaccagcctgggcaacattgctgtagagatgacatcccatctctacaaaaataaaattaacaacctggtatggtggcatagactgttcccagttacttaggaggctcagcggggaggactgtttatgcaaataggaagctgcaatgagccctgatgatcctgctgctgcactccagcctgggcaacacagcaaaaccatctctacgaaaaaaaaagttcccactgactggcaaggaaagccaggaaggggggctcaggtgccctctcagccatgtacctgttcttctggaagggcctcctcgcttctgccaggctcatcacatcttttttttttttgagacagagtcttgctctgtcaccctggctggagtgcagtggcatgatctcagctcactgcaacctccgcctccccagttcaagtgattctcctgcctcagcctcctgagtagctgggattacaggcgtgtgctaccacacccggctaatttttgtattctttttagtagagacggggtttcaccatgttggtcaagtggatctcaaactcttgaccttgtgatcctcctgcctcgacctcacaaagtgctggaattacaggcgtgagccaccgcgcctggccctttttttttttgagacagtttcactcttgttgccgaggctagagcgcaatcgtgtgatctcggttcactgcaaccaccgcctcctgggttcaagcaattctcctgcttcagcctcccaaggagctgggattacaggtacctgccaccacgcccggctaattttgtatttttagtagagatggggtttcaccatgttggtcaggctggtcttgaactcctgacctcaggtgatctggcaccttggcctcccaaagtgccgggattagaggcatgagccaccacgcccagccttcatcacatcttgagagaggacactgtctgcctcttgctctgatgagggtctgatgcaaaggatagtgagtctctacagtgcacacttaagaaaggcagcatgtgggtgctcacaggtcaggcggaggagggggagctggtggggaccaggcatgccttgctccagatcaggatatgatggcattggtgcagattatattagtatagaatatggtctcaggaaccaggcaggactttggcttccgagcagggttcagatcccagcttggccctacctgtgcagtgagatctcaagcaagtcagcctctaagcctcaggttcctcctttgccagttcaacagatgagctggcctggggtgggctgtgtggtgatggtgctggggctgggtcctctgcccctgcaggtggtctatgttgcccgaaacccaaaggacgtggcggtctcctactaccatttccaccgtatggaaaaggcgcaccctgagcctgggacctgggacagcttcctggaaaagttcatggctggagaaggtgggcttgactggaggaaggagggtgtgaagccgaggggtggtggctataacgtacagcaaccctgtgtcggtgccccctgcccgcttctctagtgtcctacgggtcctggtaccagcacgtgcaggagtggtgggagctgagccgcacccaccctgttctctacctcttctatgaagacatgaaggaggtgagaccgactgtgatgcttccccccatgtgacacctgggggcaggcacctcacagggacccaccaaggccacccagccccgtccctgggcggctcccacagcaagcccggattccccatcctacctccctggcccaggcccccccactgcagccccacctggcagcaggctcggcacagctttcatcttctgcacctgagtcagctgcatgggtggccacggatcagatacttagtcctattgcttatcctcaccaaagggtgtgccacccagggccacagtcatggaagaagaccatcccggtcctcacccataggcgccaagccctgttcatgatgggatcacagggcagagatcaattcattttactccagagactagggccccaggggttgaggctctttggggtttctaggggaagtggccagatcccctctgaggttagagagggggacccgttttgttttgctccactgaggagccctctgctgctcagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggtgggtgctggccagcacgggggtttggggcgggtgggagcagcagctgcagcctccccataggcacttggggcctcccctgggatgagactccagctttgctccctgccttcctcccccaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaatatgatttgtgttcatgtagagcctgtattggaaaggaagagaaactctgagctgaaagagtgaatgcccggtggggccacatatggtcacctctcccccagccttcagctccccaggtcaccatatctggggaggggagaagggtttggagaagtaaaacccaggagatgtgtggaggggggatgtctgtttaatcccagcacatcctctgctgtcctgccccaagatggtggaggacgtcgagtccgccgggcagcgtcactttttcttgggctccttagaagctaccaggtacctctgggccacactgagatgaggggagtagccgcctgcataggaggtgtcttcaaacaggatagtatagtccctcctgggggttgtgggggtaggtggccaaggaagggtagaggagcaagcccccggggctggttgtcaactcactttgttggctggaattggttgtaacttgaccacctcgggcaggatcccactgctcatccccaa

SEQ ID NO: 3321 - DNA, 636 bp, Homo sapiens
  Genbank Accession No. U20530
atgatttccagaatggagaagatgacgatgatgatgaagatattgattatgtttgctcttggaatgaactactggtcttgctcaggtttcccagtgtacgactacgatccatcctccttaagggatgccctcagtgcctctgtggtaaaagtgaattcccagtcactgagtccgtatctgtttcgggcattcagaagctcattaaaaagagttgaggtcctagatgagaacaacttggtcatgaatttagagttcagcatccgggagacaacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgagtaa

SEQ ID NO: 3322 - DNA, 3143 bp, Homo sapiens
  Genbank Accession No. U20758
ggggaagtgtgggagcaggtgggctgggcagtggcagaaacctgatgacacaatctcgccgcctccctgtgttggtggaggatgtctgcagcagcatttaaattctgggagggcttggttgtcagcagcagcaggaggaggcagagacagcatcgtcgggaccagactcgtctcaggccagttgcagccttctcagccaaacgccgaccaaggtacagcttcagtttgctactgggttgtgcattcagctgaatttcatggggaagtccaaattctaaggaaaaaaatgtggtagtataaaaaggtatcactgttgtaacctatgaagatgtcagctattcctttgaaatattttgcaggaaaactcactaccatgagaattgcagtgatttgcttttgcctcctaggcatcacctgtgccataccagtgagtacagttgcatcttaaagaaaattcctgaaaataactgaattgtgtgcttccatgtgctaggaggacattcttgtaatctttcttcatcttttctgtttctaaggttaaacaggctgattctggaagttctgaggaaaagcaggtaagcatcttttatgtttttatatagttaaatcatttactcaattatggcgagaggtgcaagaaacgtatttgctgcgatcaaatgagttcatatttgtaaagcaatttgaaagagtgcctagcccacagtaagtgctacataagagtttgttaaatgaatctgcaaaaaaaaaaaaaattacaaaaaggtacctaagggtccgggtgactatatgcttccatcaagactagtgaagaatggttgttttttccattcatccctacatttctttttttaataatgataaacatgcaacttttttgtagctttacaacaaatacccagatgctgtggccacatggctaaaccctgacccatctcagaagcagaatctcctagccccacaggtatttttaaacttctcataattaaactacagtgatgaaagatagccacactcaggccatttgggctgctcagatgaatcctgccctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcagaatgctgtgtcctctgaagaaaccaatgactttaaacaagaggtaagttctcattttcaatcagaggcccatcatgccttgaagagatgaaagaaggcattgcctggattctcttctgatgaaatttcattagcaagttttccagctaattggcagtctaaaacttgctcataaataaaacatgtatttactaaatatcagaaatactaggtttcctcggataacctaaaagccatggtatgtactgtgaatgcaaagattctgaaactaaataaaaagaaagatagtaaaagactaatgtgctataaaggctaagggaaaataaaaacccatatattaattttcccggccatcttaattttcagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccaggtaaatcctttaacagacacacctgatggttctgactagcgctcaagtctaggaaaccacagtttgcatattcattcattcattcatccattcattcatccattcagcaagaattcattcatattctactttatgaccattgaatacaaatctttttctgcttggcggtttttgtaagtctacataatttctctctagatttgattctcaaacacaattctactttttgaaatcctggatcaaagtaacatgctagtattatttcagccagatttagacaatttttagtataagatgacctaaaagctagagagtggaaaaggattaccatattcccatccctagccgttcatataattattcttcatttgtgccgtgattcagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaacaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatcttttgtggtgtgaataaatcttttatcttgaatgtaataag

SEQ ID NO: 3323 - DNA, 4409 bp, Homo sapiens
  Genbank Accession No. U20938
tttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctgaggagatggaacttgctaaggaagaaaagtgtgaatttctgccattcctgtccccacggaaggttatagtaaaaggtgggagaattgttgctatgcagtttgttcggacagagcaagatgaaactggaaaatggaatgaagatgaagatcagatggtccatctgaaagccgatgtggtcatcagtgcctttggttcagttctgagtgatcctaaagtaaaagaagccttgagccctataaaatttaacagatggggtctcccagaagtagatccagaaactatgcaaactagtgaagcatgggtatttgcaggtggtgatgtcgttggtttggctaacactacagtggaatcggtgaatgatggaaagcaagcttcttggtacattcacaaatacgtacagtcacaatatggagcttccgtttctgccaagcctgaactacccctcttttacactcctattgatctggtggacattagtgtagaaatggccggattgaagtttataaatccttttggtcttgctagcgcaactccagccaccagcacatcaatgattcgaagagcttttgaagctggatggggttttgccctcaccaaaactttctctcttgataaggacattgtgacaaatgtttcccccagaatcatccggggaaccacctctggccccatgtatggccctggacaaagctcctttctgaatattgagctcatcagtgagaaaacggctgcatattggtgtcaaagtgtcactgaactaaaggctgactttccagacaacattgtgattgctagcattatgtgcagttacaataaaaatgactggacggaacttgccaagaagtctgaggattctggagcagatgccctggagttaaatttatcatgtccacatggcatgggagaaagaggaatgggcctggcctgtgggcaggatccagagctggtgcggaacatctgccgctgggttaggcaagctgttcagattcctttttttgccaagctgaccccaaatgtcactgatattgtgagcatcgcaagagctgcaaaggaaggtggtgccaatggcgttacagccaccaacactgtctcaggtctgatgggattaaaatctgatggcacaccttggccagcagtggggattgcaaagcgaactacatatggaggagtgtctgggacagcaatcagacctattgctttgagagctgtgacctccattgctcgtgctctgcctggatttcccattttggctactggtggaattgactctgctgaaagtggtcttcagtttctccatagtggtgcttccgtcctccaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaagaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatcttttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggtcataaaatagaataattcttttctgaggatagtagttaaataactgtgtggcagttaattggatgttcactgccagttgtcttatgtgaaaaattaacttttttgtggcaattagtgtgacagtttccaaattgccctatgctgtgctccatatttgatttctaattgtaagtgaaattaagcattttgaaacaaagtactctttaacatacaagaaaatgtatccaaggaaacattttatcattaaaaattacctttaattttaatgctgtttctaagaaaatgtagttagctccataaagtacaaatgaagaaagtcaaaaaattatttgctatggcaggataagaaagcctaaaattgagtttgtagaactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaacaaaatgagatgataggatagatcctggttaccactcttttgctgtgcacatacgggctctgactggttttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcatttt

SEQ ID NO: 3324 - DNA, 927 bp, Homo sapiens
  Genbank Accession No. U21049
ggaagtttaggttaactgtcttaaatttccaaagctgtaatcattattttcattctcaaagtgatggccttgtgttttgctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttccaaaa

SEQ ID NO: 3325 - DNA, 956 bp, Homo sapiens
  Genbank Accession No. U21931
gaattccaacccaaaagccttcggagaatcgtaaaaggaatgcacacagagttgcaaacaatatcacactgtttggaggagccggtctgctttccagatgtctgtagccagacaccaccatggattttttttattgcttttagaataggcgaagccatccaacacacacagaatcactcattaagtccagtttccatggtataaagagaaggcaatgatcgcttctgccaaaatgtcattctgtccagtatgcaggtggtctgtctcatatttgcatcgggtaatctattgctggcactggcttgatgaatggttgaatttaaccaaatggttaactgttttgtctcagatgcaacctggggtgggaggaaacttttacagcctcataggaaggaaaaatacagtattcgttcccttggaaactcccaccagctctgcatgttttgctgcagaaaagtctcttttttacgcaataccttctgatacaaccaggcgctacccggtcttgttttccagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgtatctggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaa

SEQ ID NO: 3326 - DNA, 2282 bp, Homo sapiens
  Genbank Accession No. U22029
ccctgggtcttcctagccccgaggctttcaagtccatattcctggagtcccccctcctgagacccttaaccctgcatcctccgcaacagaagacccccagatgcacagccacacttccatctcaccctaataaaacccagacctttggattcctctcccttggaatgcccaaatccacaactttggggttgcattctcactccaagatcccaaatccaaagcccaagtgctcccctatgcaaatattcccaactcctttgttctacagcttatctgttgcccgctcctaaatccacagccctggggcacccctcctgaggtaccacagatttagtcgggaggtaccctctctgttcagcttccctggggtccccctcctcctcctttgctggttgtgtccaaagctaggtggggttcacggagaggatgtagttgggaggtgaaatgaggtgattttataaccagccaaagtccacccctttttttcaggcagtataaaggcaaaccaccccacccatcaccatctgtcatctcactaccaccatgctggcctcaggactgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaagttcagtgagtgctatggccccgtgttcaccattcacttggggccccggcgggtcgtggtgctgtgtggacatgatgccgtcagggaggctctggtggaccaggctgaggagttcagcgggcgaggcgagcaagccaccttcgaatgggtcttcaaaggctatggcgtggcgttcagcaacggggagcgcgccaagcagctcctgcgctttgccatcgccaccctgagggacttcggggtgggcaagcgaggcatcgaggagcgcatccaggaggagtcgggcttcctcatcgaggccatccggagcacgcacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcgctgatgaaacacctgccaggaccacagcaacaggcctttaagttgctgctagggctggaggacttcatagccaagaaggtggagcacaaccagcgcacgctggatcccaattccccacaggacttcatcgactcctttctcatccacatgcaggaggaggagaagaaccccaacacggagttctacttgaagaacctgatgatgagcacgttgaacctcttcattgcaggcaccgagacggtcagcaccaccctgcgctatggcttcttgctgctcatgaagcacccagaggtggaggccaaggtccatgaggagattgacagagtgatcggcaagaaccggcagcccaagtttgaggaccggaccaagatgccctacatggaggcagtgatccacgagatccaaagatttggagacgtgatccccatgagtttggcccgcagggtcaaaaaggacaccaagtttcgggattttttcctccctaagggcacagaagtgttccctatgctgggctccgtgctgagagacctcaggttcttctccaacccccgggacttcaatccccagcacttcctgggtgagaaggggcagtttaagaagcgtgatgcttttgtgcccttctccatcagaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgaaactacaccatgagcttcctgccccgctgatcgagggctgtgccggtgaaggtctggtgggcggggccagggaaaggcggggtcagggcggggttcgcggaagaggcgggtataagaatggggggaagatgcgggaaaggaaggggcgtggtggctagagggaagagaagaaacagaagcggctcagttcaccttgataaggtgcttccgagctgggatgagaggaagggaaaccttacattatgctatgaagagtagtaataatagcagctcttatttcctga

SEQ ID NO: 3327 - DNA, 40433 bp, Homo sapiens
  Genbank Accession No. U22376
gaattctttattggactatgcatattcccaaacatattattgtcatacaactgagggaaaaatgtaaaactatatctgggaaatgaaaaattataaattctcaaaatgatacataggaaaatgatttacaaagaaaaaaaaggaaaactgaacttagtatctttctactttaaaggggttcaagaacttaggagtagttacacacctcctaaaatcttgaaaaagaggctatgaactcacttcacaaagggttcagatactcacattgtgtccaagagactcagcaattgggaatcttgccagttagattcataaagcaatccgaaagccagaatgcaatttctttaggggtggtttctagatgtttattctagatatttttaaaagattttgtttatttttgatgtgaagaaagaaaattattatagaatctagaaataaatattggctttaaaagtattaatttgccttgtcctttgtaattgtgatccgaaatatctcacaataattttgtttcagtgttattttcttctcaggaggaaaggaatgttaaaaccttactagcaactaacacttgataaagatttaaactatataacaattttaaagaaagtctaaaacaccagatagtcttgaaacctcgcatgcttcaccgtttaataaaattatgactcattttagtaagaacatgcttttttagtaagaaaaaatgctttctgagctaagtttgaactgctggggcacatgggacacccacaaacccagtcagcagaagtctcaaactcctaaaagattaaaggaaaaatacattagtgtgtacagagaatgaaaaaaaaatccccaatggttctaatctataaacggaagtaaaactaaaactcccctaaaatccccccagtcatcaatccttataaattcagcacttatcttcttcctttacttctggagaccctcattaaacaacacgaaagcctttgctgacttttatctcgtaaaatagagccctcaaatgacactaagcagggataccgacctccaaaatcacaaactgttttacttctaaaaccatgcatgcaaacgtggggtttcctgagttctgctaggggcgggctgtctggacccccgtgtattttttttttttttttttttttttttgcaggtgtgcaatccagggtgcgcgctctgtgcagggaggggagcagaggtgtgcggtgggcaccgcctgggccgggcggggcggggtgggtggggcccgggtgtgtgctggggtgagagtgaaggacatgtgacaatacgacggtggcggctgcaggatccgggaggggagtgaaagctccgctggggcgctccattagtgagcggtgatggttgccgcccacttgtattgaagcgtcctttgtcactaacaagttaaattagagatgttatttatttaagaagaaggaaaaaaaaccctagccaaacagcctatgaatacatatgctcacatcccctactcctccaactcctaatttccccgtctccagagggcacagttgtaaaccttgacgaaaatccaatcttctgtgcgggaatttccccccaccgcttgccgcccccgcgacagtgagtgggagctggaggagctctggtcccgctgcccgggagcacgcggagccgggcgaccgcggtgcggcagccagggaggaggggaggcggcgggactgggcgcgggcgggccgccgccgcgacccgggagcggggtttgctcaggaaaaggcgccgtcgcggcccccggccacccctccctggccccgggctccctgcccgcgcgcctcccgggcctccgggcggctagggcaccgcgcgggcgagcgccgaatgggagcggcgacccggccagcccggcagcccgcgggcggcagccagggcgaccgcggaggcggcgggcagggcgcgtgcgcactgcaggggcgccagatttggcgggagggggagtgtccaaagctctttgtttgatggcatctctgtttacagagtttacactttaatatcaacctgtttcctcctcctccttctcctcctcctccgtgacctcctcctcctctttctcctgagaaacttcgccccagcggtgcggagcgccctgcgcagccggggagggacgcaggcaggcggcgggcagcgggaggcggcagcccggtcggtccccgcggctctcgcggagccccgccgcccgccgcgccatggcccgaagaccccggcacaggtaacggggagccgggcgggcggccgagggcgggggcgggggtcgcggggcgccaggctcccgggagcaggtgggaattcgttccgggatcatctgaggggctgtcagaccctccgaggacctggagcccctgcctcggcagcagaagccgctccagagactgatgaatggaagagtctttgcgggaaatgtatccggacgttgggaagcacgccctgcggctcattttgcaagttgcatggggatacatttttctttagggggaaaaagaaagcacgttccagccgagggcagagcggtgcccaccagccccggggagcccaccaggtgcctggcttgatgccgcgggtgtcggcgagggatccgcagcgtaattgctggatgcattgagatatgtttggacttggaagtgcagagcatatggcagatacagggaaaatgctggattgtttagtagctgcaggtagttcatttaaatttcattcattctttatggaggcgaggaccagtgtcagctgacaggcggctgaaaagcagattttagggggataaaggggtctctacttttgcaaattgtcttaagacctggttttggaggttcgaatcatttttctctgaaaggcttttacttccactgcaaacattgcacggcacccacacgccgccgtcgcacatgtcactgcacttagggaggctcgccgggaagatgggtgcagtcccttcacatttttggccggacagatgggaagagggagaggaggaggaggagggaaatcctcgtccgaactgtcagttgctcgttccccagtctccaccggcctctggactttcccagcagcacacgccggggctccctgcgagcggcgggtgcagggctagctcggcagccgtcgcagtcgccactcggctcaaggggacagaggccggcagcacccaaggccgctgcgcgcgcaaccgggacgcgatccccgcgggctctgcccccaggccaaaggtccccgcctggggcgcacgcgtggatgcggctgaggtcgccgcgccttctcgcaccctccttcagccgccttaggtcgccccggccgaggcgcggtgaccggacagatcctcgcgaaggagttctaaggcgaagtccatggaggcaaagcaaatccattcgcctttccttagattgtttgattttctcctactggtttgttgttgagcctgcggcgctggtccccgcgcggcgctgggaagttgcaaagagcgtgggtggagaccctgcagcagcacccgcgggctgggctgggcggggagcagcgccggggcttggttgggctctggggacgagagggcgacttgggggagctccgggctccctatgctcctccggagcctggccgcgcaggacggtgtgctgcccctcgacgctccacttttcgcctttaggacttcacaggacagctaccggggtcatctgtttttttttttttttttttcgagagctgaaactggcagcaggaggagggagtcgggcaggggtgctgggaggaggcgcggcacggctccgccgccccgaggtctcggcccccggggcggggccgcgcaggttccctgaggctccaggtagcccagaggggaggcggctgggaggggcgggagccttgaacctgcctcaggggaagagaaacccgactgcgggctcggagccgtttcttgcaagggcgagcgtcaactcggcagggattatattaaccaggtcagcgaaatgagtttgaacccctccgaatcacagtagcggccacaaggcacttcctcccgctcccctccctcttcctaacccccagcacctcttttctttttcgtttctttgcacggtttgtttccttgacagaatgtaacattcatagttgtactcttgtaaccacaccgggtctagcaggtggggagtcgagtgcatcaaccctgaaatcagcctttgaaaatcctctgactgttgggtctgagatcttgtcagagcagataaaggaaaagttatttcaggttccttagtagaaattaatcatgcttctaggacgacttagagcaagcaaatcgcatgcaaagttcaaaggcgagcctgggtggccagcctggcagggaaactcaggagctgggcgcgtgagcagccccggactcgccctgctgcgtcctggccccttcaggtcctgcagaagtcactctccaccttgcccccaagaccttagttttgcacatctttgcctctgtgcttagcttttaagaggcacggaaggacatggcatggtcatgtattagcgctggaaagtaccttagaaataggatccaagcaagcccttattgtaaaggcgaggaactgaagtcttgagagagaggaagtgatttgtccaagtcatacagctaggtggaggctagactagaacctttgcctccagaaccctagtcctgttgattcccgtgctctcacctgacgttggctgccccctgcgggcggctgaataggttgcttgttcctgggttgttaaaccgctgcggagagagaggtgctcaatgactactctgaaaaatgtgctcagttctgaaaatgtgacctctagatccagccaaacctgaaaagttaattcgacttgaatctatgactgcagtttcagattcctctggttttcttggtgtctctcacatttcacaagggactgcatttggggtctttccaaggagttccctatgaatctttcaaaagatgcagacttacacctctgggctttatagcttttttttttttttttttttttgctttatcatatcgtgttttacatttttgtagttcttgttcagaagttgtttagtgcctcctgttgacagtggaaacagaactaggctattgtttcaaaacacagacactaaatgaaaggaattattacagattataaatatatatttcctgggattttatttggtggtggtggtattttaaatttggattacatcatgtcgccattcaacctggactatcagattgttgcttaaaataatagctttaaattatgagaacccccaattcaggatttttggtaagcacttcagcttcacttgtagggggctggtaatatgcataccagtgagttagtttgggaagacaaaacctgtaatgaatataacttttctttttaaaaacaatgatttacattatgatatggctttatatcattgtttttattggtcttagtttaatgggtttcccaacattgcaatgacaaattttagtgaagtttctaagatagtatttttcctattttaagttttataagaaaaactataaaataaaccgtgtctgtaaaattattgtcatctgatcagttgattagattaacaaacattatgattatgattaacaaacagtaagcatatagttacttcttcaaaagtcataaaatttcctaggttaggttaactaaataaaagaaaaagctttcgaaaatagtaatgggttcttttaaatccatggcttttttctggggaaatcccttctggattaggttacattttataatatttcaaacaccattccatcagagacagaaaaaacaagagtaagtaagactctgactaacaagtggcctaattattcacttagttactctagaaactaagtattgtaaacatgggcacaagttggatcaaccaggcctggagttgtgagcaatttggtattaattttatttacaaaacattaaagcttgatcactcaatgttcttatctttgctttggttttaaaatcctttcctcttagattctcctaatcctctagactttatgggatcactataatcctgttttgcgctgtactacttcttgatttttttcttcttttaataaaacaaaaaccccattggaatagcatagttgaattgtttattatgtttgagaaatattatttaaacgatgtgacagatgccaaagattttgagtgtgcacttatataaaggacatgggttcttcttccttttcttatccttaaccttaagttttcaacttaaaccttcactggttggaaggtggccaaatgtataacttgtccctggtctaatagtaacagcaggttcagacatgcaggggaataggaaggtgccaggtccttggccgtgtctgtggatacccataacagcagaaccagtttacaatactagagcaacagaatgcagcaaacaatcttgttgtgcaagttttcaaagttttgtcttcataacctttgaaaagattgttgaggagttttgtgtaagttttgtaatccagtagtagtctaaatcctcttgtttcagcccacgtctacccattcttatttctgcagcatatatagcagtgacgaggatgatgaggactttgagatgtgtgaccatgactatgatgggctgcttcccaagtctggaaagcgtcacttggggaaaacaaggtggacccgggaagaggtaactaatcattttatcaagacgcagaaaatagatagagtgtataatttataaaaaacaaaatttcaactaaactacaggtgctcaagctcattagcaggctccttgagatcttatcctagcccgcatgtgcagcgtgccctatgccccccacttcattatattatccatttccacactatttgcagttctttgaatgtcctcttctcattttaggcttcatctgtgtttccttttgcctgttgagttctcatccttttgtcccacctcttcttcctacttttacattacccatgaaggcatcacctcttctgtgaagccatccctggcttcgccggacaaggattggatgcatcctcctgtgatcccatgcatgggtgcatgttctactttattgttgctgggacatatatacctcctccagctgactgcaagtctgttgagggcagggctcttgtctattcatctttgtgtttcctgaattcacaaatgcttggacccaaaataggatattaataaatgttctctcaataagtgaatgacttgctactcccaaaaacaaaacaaacaaaagaataaaacaaaacactcagagaactcatctttttacagtgtattgatttaatatccttgatatacttaacagagccatctatatgaaggtatgttttaaaatcatccgataatggatggagacacatctgcttctcctgtttctttttcggctggcttatcaaaagtttgattttgtaggaatggaaaaatattttagaagcaaaattattaatatgtggagaaaagtttctctaatgttcttaaaatttttgcaactaattttagatgattcatgttacaataaatggtattggctcttcttcagtttcactgttctctgcttcatttaaaccagagctccttttaacaggcaggtaggattcccagagaggcccataggaaattcatattttacctattaagattatccacttggataatccttatgatacggaaattctgttgtcaacattggtttcctaattcttgtgtctgtattgtaccagggacctccactgtgtgtgaatgttacctttgcagaaacataagaaggaatgcatttatatacttatgaactggtaggattgtgaacagcatataaactaaaagaactgattagctggaaatgtttaatgtcttttatgttctaacacatctggcctatctaaatctaactgattttcttatatagctttcaaatttaattttaaaaatggtctttatttcttttataaaaagttaaactaactggaaatattctatttcttgctcaagatcctatttattaccataggtaaatgtgtactgaatctagcactggaatgcattttttcctaacagagtaaagcagttatttataataaacactcaatatatgccaggcattatgataaatgttttgcaaaattgcctcatgtaatccccaaataaccctgttaatatcagcctcatgttaataaattgccccatgtaatccccaaataaccctgttaatttccattttatagatggcaatactaaggcccagaaaggtaaaatggtatacccgctttacacaattaatagttgagtcaagatgccaactctggtctgattctaaataaatctatactcccaagtccgtatattacattaatatctcctgtattcggatactttagagagactttttattctagattcgttccctcattcactttaacttgaacagagttatatagtaaataactgatatcctaggattacctttaaatgtcttaggatgaaaaactgaagaagctggtggaacagaatggaacagatgactggaaagttattgccaattatctcccggtaagttagtaagtttttcttataacgaaaggaaagcttctcccaaagatttctataaaatattctaggaggagttattaagatagtgtataatttactcacatttaagaagtgggagaaatgccctacccataacttatattttatattataatgcatataattaaattattagaatttagattattagaatcgattattataatttagattatcaaattttaaaaacagttgcttcttgttttatcttttcatttataggataattagtattttgatgatttgttacatggtagttgattaaacttgatatttcctccaagtcagtttttcctgaattccctatttttgtcaatagcaatacttttggcaccaaggtttaaaattctgaagacctttcttgacttatcacattcccccaacccctacatctaagcagttactaaggaccctggaattcctttatagtcagtcccgtccttttcattctcatggctgtgctgaaggttgggctcctgcctctcatttggactatcatataacttcctaactggcttccccacttgtagttttccatttttctttcttttttttttttttgttttttgtttttttttttttgagatggaatctagctttgttgcccaggctggagtgcagtggcacgatctcagctcactgcaacctccgcctcccaggttcaagcgattctcgtgcctcagcccccttagtagatgggatcacaggtgcccgccaccatgcctggctaatttttgtatttttagtagagacaaggtttcaccatattgatcaggctggtcccaaactcctgacctcaagtgatctgcccacctcagcctcccgaagtgctaggattgcaggcatgagccaccgtgcccagccagtcttctacttttccattcatcccaaacaccattggcaggtggaacttcctaaaatgcagctgtaccttatcttttcaaaaccaaccacagtgacagaatctcacaaattaagtaaactgccttgacttggcacacagaggccctcctctattgccccaacttacagctccagttctgtttcctgcttcctctctctaagcaggtttgcttgaatttatttctgctttacctcctctgggcttttgctcctggtcttcccacctcctagaatattctccctttatgtcaccaattaaagttctgtccatccttcaaagtccttatgaagagctcttcaagactcctcccaaggaaaccatttctcctcctaagaagatgcttctctcctcacttcagtatcattttgctttggtcttttcttccaagtgaatcaaattcagcatctgtgatagtcagtcatctacttgtcttttccttcttataagtttacaaactcctgtaacataggacctatcttttatgcatcttttttctttctgcaatataaatactttggtcctggattgaagcacatctcttgtctgaatgggaagcaaactttagtcttttagggtggtttccatgaaagcctgacaacatagaatctctatcaagcctcaggctatgtagatactctgcaaaagtatctgaggttaaggttaacttggcaggcacatgtgtagtatgatggtcctttagatcatgtggcaggaatgtttccctcaggaggcagagtgtctaattttagatgcaactttgatatattacttgcatgttctgtagcctgtaagtaatgagggatagatgggctctaaacatgctctaaaatgttcttaaatattttcactgcatatggtctatgtgtgattcctattacaacaaaaaattcacgtgcttatcacatcatatctttatggtggtgcatactttatttgtctagaatcgaacagatgtgcagtgccagcaccgatggcagaaagtactaaaccctgagctcatcaagggtccttggaccaaagaagaagatcagagagtaagttctttcttcattggtgtgtgactcataattaagaatattcccaaaatgctaatattttcctatttgaggaagcaggtaaattgggcaaacaggaagtagaggactctattcccatatttccagtgaatgaaagcaaattttggaaattttctaaagatcttgtaacactgaagaatgattatactgactcattacataactttaaaacataggttatttttgtgtgtttatctgaaggtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacggtaataatatgtcaaaaaatatattgatcgggaagaatgagggagtgggtattgaacattctgctttaaatgtatggtgagtaaattatatttcatcagtcgtaagtgttttattagataaaccagctacatagcttttagagattgaagacatcttagagtttatttggttgagaacttccaggatccacctgacagtgagccctgggtgaagacatttagctttccccagcctcaatttccccatttccaaaatgaatcatacagggccagtgttaggatcaagtaaaatgaatgtcaaaggacttggtaaactataaaactctaaatgcatagaaagaaactgaagacagtttgtctctggcagttcacgtagctggttaagttactcaaaggaactcagctaccattttcctgataaccatcattcatttcttttattttttttaattattattttttagagacagaggcttgttctgtcacacatgagtgacagagtgcagtggcatgatcatagctcaatacatccttgaactcctgggctcaagggatcctcccacctcagcttcttgagtagctaggactacaggtgcaccccactacacccagctgattttaaaatattttttgtagagatggaatcctgctatgttacccaggctggtatcaaactcctggcctcaaacaatcctttcacctcccaaagtgctgggattataggcatgggccaccatacctggccaccagtattcatttcattataccactttgcttaattttttacttcattgattaaagaaataatgtatttcttgaattctcatactacttccaggtttttaaataatgtcagggtaataatgctttctttttaatgaacaaggcaagaaaatgacctcattatgagggataactatggaagctcattttgtcccatttttcccacttaagtagtatataacagattttgttcctttggaaagcaatacttttaatgataaatcttgcattaaaatgatgtagatcaaaaatattaaaaatagttttattcttgagcttcataatccaggagaaagtttatatagtattctctagtgatgctccaaagcatttgcacccttgtggttcagtataaacttagaaattttaagaggttggtaaaaaaaggcctttcctcccatatggcctgagaggatacactgctgattcttctcaaaattaacagggctattgaacttcctctttctttagcatacattcccccacccccattgaaatagaaaaagggagacttaaacggtttttttgaattgagaaactgttttcctgagaatggaaagactttagtaaaaatgcgttgccttttgaaaatatactgggggttaggatctttccctttgggatcccattttccactctcgtctctgtctgattcagaaaacaattggggtggctttcaaagagtaggaggttttttggtctcagaagttctcactagtgctttgagagataaagagtgaagtattcttcatcagcagcatcttatcatccaccagacttcaccatgtccctctcgtggtgtgtaggccctgctgtgccacattcaaaggagtaatttccccaaggcagctggaactttacattgtgttggagtcttgtaccgcgaccggtcagaataaacatgaagcgttatcgtattgaaaatactcctttaccaaggaaatggaatggttaaaagatactgatatttctagaaaacgacatgcattccagattgtgtaactaagagaaatctaactaggcaatagagaaagcctgatctcagagggtggagaagaaggaaacaattaaaaagagaaaacaactaataggcccaagggaaaggtctctgttagaaacagttttctgtcaattcactttaatctgaattgaaatttttgtttgtgaaatttgtgtgatatatttctgtgcagaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtaagccattcctgtgaatctagtttaatgagagagacggttagtttagctccaggtaataatcatactttgcagttgtatacttttcagagaactttcctgagcatgatcatggccagtcttcacctatgccctttgaagtagatagggtgtaggtatggtgtgttacccctggtttatgtctccagaaacgaggatggtaagcgctttgcccagggtgacacagctcatagagatagtgctgactagaaaacgagctgtccgattctaaattgctgcttcaaatctaatttgaaggcaacctttgaatgtaaatttacttaaggtactattgaagaataggggaatggagtcgcatttgtagatgtaatgtttttctcttccaaaacgaaaagggaaggtagtattatgtttaaagaggagggagtttgacactgaaattcagtggttatggtatgtttcattctggcagtgatcaggcagacatgtcttaatttattcactcagtaagtgtttaccttcttactctgagtcaggagcagaactttgtgacattcattttctgatgtctccttttagtctccgttggatcagtgtgatcccttccttatttctagatatttatatttagggaaagtgataatccataataggtggaaaaagaagaagaaagaggaaaaaaatcgagaaactttaatcttaagaataacaatattaaatgataaaacttacccaagaatagagagctcatatgcaaattatatgcaaaacatgttcataaatagtttttattcttctctgtccatggatttgactacaaactttacagaaaggtctcagatgaataaattatcataagaagtcctgtgctttttattaaaactcaaaattattccaagaaaaatatttttatttacaaacagctggtgccatcaatttttcccatagaaacaattttgaaacattcattaatgtattttataatatattttttattgtttttttcattgtgtttttctctaattaaggaacacttcccaaaatttaaagtgctcatcaacacctcccaaggatttttcaccatgttcctttagctgtttagccattttaaaggcctggctaaatttcacattaaaaggttttaaaaatttgtttagtgtattttatcagtaaagtgttttttttctctcagtcccagaacgaaacctcaggaagccaagtcccctgaagcatatgtagccctgaatgacgtggcctttgttttgtcttttgcatctaggtctccagtcatgttccataccctgtagcgttacatgtaaatatagtcaatgtccctcagccagctgccgcagccattcaggtaagatcattgatcattcactgttcaaagcaccacttttaagaaatgcttatttctttcatctaaacacatatttttacctgagcaactaaagtaaaaaggaaagggaacatggagaggagagcagagtcttggccagcaatctattaatcttgtcttctagaatgagtttgctctggaattttctgattctttgatgttgcaaggtgaaataactcatcagtcagcatccactctagcctgagatttcacatcactcccttaagtctgaaataacattcacaaagatttctgcaggagccaaatttggttggtggtgttgtcacagtgaggctctttgggctgtgcggcacctcatgaccatattggctacacccattgtatttgcagcttccaatcagacctttgtctttatttcccttactttgtaatttcagagacactataatgatgaagaccctgagaaggaaaagcgaataaaggaattagaattgctcctaatgtcaaccgagaatgagctaaaaggacagcaggtgctaccagtaagactgtcatcatgtgcttgaatgaggggatagcagctttgcctcagtttacctaagcgctcttctcttctaaatattacacttagcaaggctccatatatccattcagaatgtctcaacacaagaagttgcttgtagtaaaatgtagttggtatcagattatatgctgattaaattggaagcagtctttttgtaattgcaataaaaatgcaatatccacttatgattgttatcatcaatttttttcttcagaaggactataatcagtttaaagactagcaaagataaaatgaatgaaaatctgcattttctacagagctatgtatctatatggtaccattttggtttttttctattattttgttaacctatattttcatattttataatttcagacatgatttgatgcatgttcagtatatacatgtaaaaggttatatataaaacctcttcataaataacattagctgctctcttttatttgcatgtgtgaaagttatgtgggccattactgaattctgacatctttagcgactgggcagccaactgggatggctccttgtgctttgcaacatacatagttaaccaacaaagacaataaaagagaagtgatgcccagtaggtattcctaggggtaaatttattttttgttaaataataagatgtttatgtgcacatgctagttcgaccactttttaactttagttaatgttttgcaatttctcctgttgtgtggtcatactgtaaggagacttctgttaatttgctcttctgctttcctaaccacgttgatttggcagtgcttcactgcatcagtgcaatctgtagcattagaaagggatagaagcaacaagaatatgtgtagatcaaagcaactctaactcctgagtcctctagcttttttgtggttagaatgcaaataggacagttcttcagttcttcactcacagcaagcatttatggacctttggcaaattatattaaagtggaattttaagacaatatgataattatacttcgaaatatagacctatgatttgacatttttacaaaatgataacaaggtaatcatataggtacaacctctagcactattaaaaacagggtcttgcattgataaaaggaaacatcttgacaactgtttcataggcgtaagtttgggatgatgcaactactcttatctttcctccaacagcatctgataccttgtgcaacttcattgctaagttccttctccctttcttctgtcctctctttatttctacacccttcccccttccttagacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctgtaagtagaattgtgaagggaagttaacgattctggaagataaattagaaaacccatttcttaaatcattgccattttctatagccaagctgttattagcatatattaatgtaaaggtagaagtatgattttcatcttcatgaatatgttttttcaaagatctgatttcatagcctaccgagagagacaaaagtatttataaatacttacaaaataggacttttgaaggaagagttttttttcacattttcacacttttccttcaaaagtcatatttttaaaaatagtcagattgatgacttataaagcagagcttggattatgggaacggaatggtgtttgagttacttttaacttttttttttctttgcttacttcatggtgcttctctagaattttgtcttgcttttgaacagcacattaatgatttggcttactcagagctgaaagcaatcttttagtgtatttgaagtaataatcagctccttggtcatacctggctctttccacaaaatggtgattattgattactggtcccattgcttcactgagatgaatcatctttcgtgaaacaaatttgtattcagcacctcctcagcgaacacttggttcctttcccagttgattaaaaatcatttattgcacactcattggttaggagatgaccattgccgtaatatgccatctagaaaaggtcttcattttgctttccattgcatgcagatgtagagtgtcgggaggtccctgcagcacatcagagggccagccttgaggcagcccactagaccctgctctactgcagtataatagagcaactgctcatcttgaagctgttgctcaagaagccaaaccaacgggcctagtgtttgctttgcgttgagcatctctctctcagtgctgtttcaggtgatgatggcacacactatctcaaagttctgtgcctcccacattgtttcaggattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcaggtagaacacaatttctgcacagctgttactcattttcaacagacacctgagccttaataatctagaaactaatacttcggaacaaatgactaattactgctgcctttgctgatttcattctgtcgttgaatctagctgttgctaagttatactgcctcccaaagtttaggctgtctgcaggctaactgttgattttggcatcattctctctcttttacttttgggtggttttgaaagatagttgcatgaaacgtacttttatttccttcaacactagagtttaacatttctgtccctttctttttctcccatctgatccctccctttaaaattgttaacatcatttcttcctcgttgttcatttattcttatgcgattcactgacccaggggaggagggaaccaaattgtgtttatataacatttgggttgcaactagaaaatttaaagctagaaaatttaaaggttccaattcatctttaaatggaagagtttgggaagaggatgagaaacaaatgcttaaggaaaagaacatatttttaatttcagtttctcaacattggctcttttgagttgtgccatactattttactagtgcagtttttgccaaggaatatttttatttcatacagcttttttaaggcatgaaaatcacaattcttatcagagatttgtgttcctaaattatttaaataattaaattaatagataatttggcactttaaaacatttttccaattgtatctgttgaatttgttttaagaacagatttaggtatgatataggtatatacatttgggaaacactgaatcaaacaaagttacaagtaggtttcttagctgggcatagtggcatgggcctgtagtcctagctactggggaagctaaggcaagaggattgcttaagcacaggagttcaagttcagcctggtgaacatagcgagatcccatttctttaaaaactttcttttttttaactgcaggccttctcagagttattaatatgccgttgtgccttgtgaatttccaggaggagattatgatatgttgtgtttcccaaatttattttaccttggaattgtttaaggaacacctagttttttcccagaactttagtgttctgagagacacagtttattattcaagaattttccatataatgtaaaccttctgtaatactaattttggttcatagattattaaagagaaaaaacaaagtatgaaaggaaactattaattattaactattattttccccaaaatcactaaagccttttaaatgttaataaagaacacatctcattctctttaatgacaagtgtcatttattgagagtattttctcacagttttgcaagtttttcagcaatgaccctaaattttatttcttggaaaccacacccaaatcctgggtgctcaattgaaataaaacaataccctagtcaatataacatgcttgttagcatctttattatttaatatagtgggtcaggaaaacattcttgttatctaggtgtgatttttaaattggggagaataaagaattaccatctaatctaagtattttttctttctctccatatttagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtgtaagtctttggttcaggaataaaatgatttatcttatttacttatatttaattaatggaatatagttcccagatgtctgatccacttgtatgtgcataattttactgaccatttatatataatcatgtctattcccacattgaatatatctgtcctgggcatattacaactacctacaggtagaagatgggaagataaactagattccttttgtaacttactccaaaatttcctatatatgcacaagtagttttcataaaacttttccattcggtttgtttgttccctccataaggccttcttatgaaagccagattttcaacctcctttcctctctaattgtaagcttcagaataagaacgagtatggtttcttacctagtttgtatttttatttaattttatttgtttattatttatttatttttagtttgtattttttaatcttattttttctttttgaatttatgtgtagataggacctcttctgacatccccaggaatattatatgattagaagccaagggatgagtaagcagtcatttttattcaataaagccttaatcaattcagagaaatggtagagaaagtgtgaattatcagaaaccttgaaaagaaatgcactgttatttcgaagtacaaaaagtaaattttaaaagtttaacatgttttgtagtatgggctctgttttcatgaatagggaaacctgatttgtaaatgacatcaggtcttcttgatgctcatagtcttatacagatcataggcactacatgtgtcttcagagccattaaggaaagatgttaaatcatttaatgcttttagtcttcgaggtataatattttgaaatatttgaaaatatgtgatatgcatattctctttttcttaacgaataacgtgattaatcagcacaccccaattccatatccggaacagagtttattgtattcagtggaaaaatgttaaatgtaacaggtaaagccatgtagggacatttattcttttgtattgagccactgcttgttttctttttaaagttttagaaccccagctatcaaaaggtcaatcttagaaagctctccaagaactcctacaccattcaaacatgcacttgcagctcaagaaattaaatacggtcccctgaagatgctagtaagttctagaaaagtttttggatttcattggtttattagtcccattaggagttctctctgatgcaaaaatacccactcttccgtttagcctcagacaccctctcatctagtagaagatctgcaggatgtgatcaaacaggaatctgatgaatctggaattgttgctgagtttcaagaaaatggaccacccttactgaagaaaatcaaacaagaggtaaacacgcaaccctttggaagcaacaagctgagaatcctgccccctttattccttgtgtgcagcttgatgtgtctgccattggcactgtgcaacaccacgacttttcgtgcaagattttcatacaaggtgcagcgaaaaggtactgccagactgtaggcatcatcaacctttcctttgggaagccaagccatctctatctacttcatgtttggacagaaaacatactagagagtatcaagaaaagggagggaaagaggtttttaatgtacttttaaacattactgattatataaagttgatatttcatttttagatgtgaagaattggaatttaaattaaaataatagtatctttaattaattgtattaaaaaaagggaggctgggcgcggtggctcatacctgtaatcccagcactttgggaggctgaggtgggcagatcacaaggtcaggagttcgagatcatcctggctaacatggtgaaaccccgtatccactaaaaatacaaaaaaattagctgggtttggtgcgggcgcctgtagtcccagctactcaggagtctgaagcaggattatggtgtgaacccgggaggcagatcttgcagtgagccaagatcgtaccactgcactccagcctgggagacagcaagactccgtctcaaaaaaaataaaaattaaaattaaaaaagagaatctaacctgcaaggaacaaagttttagcttgttggcaacagctgttttccaccaggttagatacaagtgcttcttgaatttattttcatgtaaagataagtatttttttttatagctaaaaatctgatttgattatttagtaatggagaattttaccagaatgtgattaaaaaccagtcttttgtcaccaaaagatcttttatgtcaccaaaataaaatccttgacggatacaacactactaggtgtatcattaaaatatattcttaatagaataaacacctagaatcagaacattggttgaaaacgtaggagctttacaggggcagtaaatttggagctagtcacatttcaaatttgccatcagtgtttctttgttgaatccagaagatagagcaaattgagctgatagtgtaagttagcaacatagttttataaaagtatttgagggactggccagaaatatactcctgactgtacatgtttcataggaagttctagaaacaacaaagcactttctatatgcttttaggtggaatctccaactgataaatcaggaaacttcttctgctcacaccactgggaaggggacagtctgaatacccaactgttcacgcagacctcgcctgtggcagatgcaccggtaagtacgtgtgcaccagcccccaagttgttatgtgacactggtgcctcatgaaatcctgtgtgtggcatagggctgctgcggtttcagcactccctctttaacacatcttatttctaaatgttctcctgcacatgatttttaaaaaatgattattaatgtagagtataaagttgagattttttcatgtattagaaacattgcagactttttcattatttgttttctcattatttgagtgccttggccatttaaaaaaatctacatggatataaaaactatgttcatttatatattttcctttatttgtcttctaaataatattgtcttcttgttaagttgtctcttgtttggtttgtgtagcatctcatatggtatcaaccacgttgtctatagtagatgcccagtattgtacccaattgctttgggttactaccaccatttttaaagtttataatttgtgaagggttgtccttatgtcttaaggaaaatcagagctaataacagctgctaagatttatttagtaggtactaagtggtaagtactgctctaggggctttcgatgaattgattcagttaattctcacaattatcctgtaaggttggtattatttttattaatttttattttttttgagacggagtttcgctcttgttgcccagactggagtgcaatggcacgatttcggctcactgcaacctctgcctcccgggttcaagcgattctcctgcctcagtctcccgagaagctgggattacaggcacccgccaccacgcccagctaattttgaatttttagtagagacggggtttctccatgttggtcaggctggtcttgaactcctgacctcaggtgatctacccgcctcggcctcccaaagtgctaggattacaggcgtgagccaccgcgcccggccaggtgggtattattatcatttctattatgtcaactggaaaacagaggcacaaagaggcttagtcatttgctcaagattgtatacctaataagggatggtgctgggttggaactcagaaggtcttgttctaaattccctacttttcaccattttttgccaataatttatagctctaaaatattgatagttctgtaccaatatatgaaataaagtgttctctccccagaacttagtaaatcttctattttgaaaggcatgtatttattaattcatttagcagatgttttttgagtgcctaacacatgcctagaactctgggatcccaaaggagctttgtgttgtggtgatgtttgccacaatgggattaaggttcagacatagttgatttctccttttagctcatagtggggagaatttatggcagatgactgcatttttttatgctaatgtgtatcatctcatagtaatctactctccacagtgttagaaaaatgtggctctcatattatccaacctcatttaaatttcaaattattctcttccctttagaatattcttacaagctccgttttaatggcaccagcatcagaagatgaagacaatgttctcaaagcatttacagtacctaaaaacaggtccctggcgagccccttgcaggtaattactattccaacattggtattttaaaattcattcactgaaaaactgtcatctttggtggtggtggtggtggtggtgatggtagtgctggtggtctgtttttcgttttcaacattttagacataggggagtaatgcttttatacaattcttgatgtctagaaaaatccaataattcctttttgctactcatatgagacatgctagaaatttttatcagtgcagattccccaaagcatgatgaaatgaaacatttcttactgtgactgagactaagatgtattacacgtgtgtcactatcttcttctgccctcaaatgttttataaaaatatatcaatatagtttactttatgttccaaattttttattttttatgctgtatccctaggcaaccaaagctcagagactgttccaattttaaatgaagtctgaaattagtcagacagaaaataattgcaatgtatttgactgtcagaataagaaagtcaactgtcaatgttgtgaggccgatctgaagttgaccatctgctgtcaggttttaatatcaaaagagatttcccttgtaaccctaaagtgggtgtgtgttgatgaaatataaccaattccaaattaatcctgagccaaatgtaaataagaatgcaaattttgcttccctaaattatttaaagcagtttctgacattaaatagcccaatacccagccacctgcagagccctctcctccatccccctgtgccatgcagagggaaacttcataaccctagaggaagtgaagagcctggattcagaagctgaaggtcatatttcttgctgtaagttaaatggcacgatcatcggacagcagcctttgagtctgcccattaccttaaagggatttcccattcttgtgatagtttctccttccaaattgtgagaatctgaaaacttgcccggtaagtatttgtgatgcttagtttttcagggttttttgttgatgttgctttgttttttgaaacagggtcttacccggtggcccaggctggagtgtagtggggtgatctcggctcactgcaacctccgcctcccagattcaagtgattcttatgcctcagcctcccaattagctggaattacaggtgtgagccaccggcaacccagccgtttttttgtatttttggatagagacaaggttttgccatgttggccaggcaggtctcgaattcctggtttcaagtgatctgcccacctcggcctcctacagtgctgggattacaggtgtgagctaccgcacctagccagtgcgtagtattattgtaaaataaggattgcaagcacattttgtttaattaaatcagattgcttccttcctggcctctctctgacagcaattgttttggtaaaatggctgtggactggaatgtgagacagggagtcagtatttatggggaatctggacaagttcctgcgtcagtgaggctggagttggccccgtgtggagaagactcagaataccacaaagaggccagacgcagtggctcatgcctgtaatcccagcactttgggaggccaaggcgggtggataacttgaggtcaggagtttgagaccagcctggccaacacggtgaaaccccatctctactaatcccagctactcgggaggctgagacaggaggatcgcttgaacccaggaggcagaggctgcagtgagccgagatcatgacactgcactccagcctgggtgacagaatgagactccatctcaaaaaaaagaatatcacaaataattgggagatgaggaagagaatgaactccacccagacataagaggaacccagaaagggagttacaaagatttcaaggcaaagggcagccatttcaaaattttcctgaaagctgttcttaggtccagaagaaaagcttttgcttttttttttttttttaattattcccacctaagttacttggctcttggtttctagagaacagaattcaactactgctattcgtgttttaattaagttagattaagttttgcatatattttctaacctagtctggggccaacttgtatttgtagtagtacagaaaaagtctgttctaaatttcaaaaagccaacacatcaatatacttggggacaattaccattacataagttgaaacccatagttcagtattgagctttatcagtatatttgtattttatttaatggaaatattggttatctttgaaactcaaaattaagttatagctctattttattaatctgtattctcctgtctatcagtgagtcatattggcactttatgaattctaacatctgtacactgagattaagttgtgtatggtgaaggtaatatttgtcaattctatcaaactgaataattgagacttgaaagttaattttagagtcaatactcctgtctaaaccatatagtttactggtttacactgaccagatatattttaataatctgctataaagccaggctcagtggctcatgcctgtaatcacaatactttgggaagccaagactggaggatagcttgagaccaggaatttgagaccagcctgggcaacatagtgagactcagtctctattaaaaaataattagctgggctgggcgtggtggctcacgctgtaatcccagcacttttggaggccgaggtgggcggatcacgaggtcaggagatcgagaccatcctggctaacacggtgaaaccccgtctctactaaaaatacaaaaaaattagccgggcgtagtggcgggcacctgtagtcccagctacttgggaggctgaggcaggagaatggcatgaacccaggaggcggagcttgcagtgagctgagatagcgccactacactccggcctgggtgactgagcgagactccatctcaaaaaaaaaaaaaaaaaaaaaaaaataataataataataataattagctgggtgtagtggtacatacctgtaatcctagctacttgggaggctagggcaggaggatcccttaagcccaggagttcaaggttacagtgagctatgattatacccctgcactctagcctgggagacaagaccaagaccttgtctctaaaaaaaattttttaaggccagccgtggtggctcacacctgtaatcccagcactttgggaggcagaggcgggtggatcacaaggtcaggagtttgagaccaacctggccaacatggtgaaactctgtctttactaaaaatacaaaaaatagccaggcgtggtggtgcgcacatgtaatcccagctacttgggaggctgcggcaggagaattgcttgaacccaggaggtgaaagttgcagtgagcccagatcgtgccattgaactccagcctaggcaatagagtgagactctatctcaaacaaacaaacaaaaatttaatctgctataatagatactaatttattttaagaaatacttagtgaatgttgttctacatacttgccaattgggaggaaaaaagaaatattcactaaatgaatgaatgttatacaccaagtatctccttcattttatgtcatggagttctagcttctgatatcacagaaatatgtgatttctaaaatgtttcagactattgtgataagtattggaaaatgcatcaagtgactctaaatatttaaacatacatcacctatatttcatataatcctgattcaataatatttctatagattttttatgcaatttggtaattttgtttgtttgaaacacagtgctatttcatatatttctattgataatccaatttgacctaattaggcatatttctcacacatggtattattgaacatattgcacatttattaaatgatatgtattttacttaagagtactttatataatctataatttttgtaatttgtacttataataaatcaaatattaagtgggattttagccaaaccatctagacatttttgtcataatgtttttattaaaacagcaaaataggagtttcaaaatattttaaaatttgaatacttctaaaatgtaaaatgtttgcaactggtgtaatgcagttgattgtctatccctctaaactgtctaaataacttaggttcaagaacagtttattgaagaacataggaactgcgcaattctgtgttttatcatttcagttttaatcaccccggcttgattatggcaacaacattttagacaagcaattattactatttttgaggcccatatactgggccattatggttttgcttctaacgtacatataaatgcacatgcaatatatataaattatgtttgctgttttaaaattagaaatgccgagaagctatgtgtttgacattttattataaattttgtacacacatagatgtatggaaaatatactatgttctagagtcaacaattgttatcattttgccatatttacctcatctctttttttttttttttgagatgaaatctcattctgttgcccaggctggggtgcagtgacgcaatctcagctcactgtaacctctgcctcccaggttcaagcaattctcctgcctcagtcccctgagtagctgggactacagatatctgcctggctaatttttgtatttttagtagagatagggtttctccatgttggctaggctggtctcgaactgctgacctcaagtgatccacctgcctcggcctcccaaagtgctgggattatagatgtgagccaccagcctgggctacctcatctcttttttatgaagtttttatttttattttttaattttttttttaatttttttttttttttgagacagcgtcttgttctgtcacccaggctggagtgcagtggcatgatctcggctcactgcaacctccacctcttgggttcaagtgattcttctgccttagcctctcgagtagctgggactacaggcgcttgtcaccatgctagctaatttttggtatttttagtagggacggggtttcaccgtgttagccaggatggtctcaatctcctgacctcatgatcggcccgccttggcctaccaaagtgctgggattacagacatgagccactgcacccggccagttttttattttttatttttttgagacaaggccttgctctgtcacccaggctggagtgcagtggcaagatcatggctcactgcagcctacctcctggactcaagcaatcctcctccctcagcctcctgagtagctgggactataggcacatgccaccatgcccagctagtttttttttttttttttagagatggggtctccctgtgttgcccagcctggcctcaaactcctgggctcaagcaatccttctgccttgacctcccaaagtgctgggattacaggcaggagccaccctgcccagcctgaagtattttaaagtaaattccaactaatataacattttattctcatgtacttccagcatgtgtctctaaaaatagacatttttatatataacctaataccatcattacatatttaacaataattctttaatcttctcattctcaggtatatttaaattttcccattaatccaaaaaagaatcaaaattgaaacaatttcacacattgcatttggttaagcctcttaaatctcttttactctctagtccagtgctgtctaatagaacttctacagtgatgtgaaggaaatatctaatatgctgctatccactatgatagccagtggcttttgagcacttgaaatatggcaagtgctgctgaggagcagaattttcaatttgaattaatttaagttgctttaatttaatagccacatttccttactctcttactggaatcagccatttccccatggtgctctgaatcctcttagtgagaaatggtacatagacaccaaaatcagggtgctaagtctgtccattgttatgtggtttgtcattgagatacaaataattttttttgttttgttttgagacagagtctcactctgtcacccaggctgcagtgcagtggtacaatcttggcttactgcaacctccacctccttggtccaagctattctcctgcctcagtttcccaagtagttgggattacaggcacccaccaccacactcagctaattttcgtatttttagtagagacatggtttcaccatgttggccaggccaggctcaaactcccaacctcaggtgatctgcctgtctcagcctcccaaagtgctaggattacaggcgtgagctgccacacctagccaagactcagtgaattttaataatccagagctctccatgtatcccctaatctataatctacagtgcttaaatagaggcttttataagccattatgtacactcatgttatgtttgtttttttaattacttagtctttttccaaaaggaatttgcaacagctacataatcttataattgttatgtttcttttatattttcacagttgttttaattttaaattgtaaaagcaaacaggatattcttataataaaaatgttctgagatgtttttcatatttgtgtctttcatgtggctcagaatatatgagattttcatgtcatatcattgtcagtattcagccttttctccacattgtgtggggtagaggatagagtctagaagcttataaaatggtcacaaatgaggaagtagagaaaacattcagcctagaaagcgtgcatttgtggtatgaaaggcactgtggaatgctgctggattctgcccttcagtagttacccgagagagaccgaggcagacgcatagctccctcctcagcaaggagaaaagagttgcctgctttcctcagcgtgctttccatttcctttgttttgaaaaaagcacattatgctaatcaactttccttaaggtagacatttttattggtagatcaaaaaccgtgctttaagttataagccttctgaacttctgtatttttctcttaaattataatttccttttattcctatttaaaacccaagtgtaaaagatgtgttcataggctttctactcactcacttgcctgtttttcgtaaccacagaatgacagccttaaattttaatttcctgacttggcttgcccatggcctgacttttttaaaacaaggagtttaagttaaagaaatttctccagccattattatttaaacacatttacacagtatcaaagaatttaaaaatgttgctagcagttgatactcccctcagctttctgttcagcgtgttttagattgctcctattttgttatttgtctatgaacttttatatttttcaaaaaaataaggcaagccctttttgcctgataggcactgctgagcagtataataaacaagcatgggggcaacagaacctgggttccaggctagactccaccgttttcaaacggcatgactttaattcatcaagtgaacacaattaagcaaagtataagtttgggaccatggaatatccttcactcatcacacaggttactgtgaagatcaaatggatataatattgctttcaagatggcggcacacttgccactatacacaggtgatattattaggcagagtcgccacatagtccctgtccttgaaatgcaggcaaggagccctcaccaaaggccagggtggttttttgtttttcgggtttttgtttgtttttttcattgtggtatattatttcctctggcatgctattccctgtcccactcttacagaactgtgtcagtgggtcaccaaaagagagagctgattcaactgattccttgaaataaaggtagtcagacctcgcggtatgatggagatgaagcaactgatttactggttttctctatttttctgctgttcgtgttgtcatttaaacagacatggaaaccgtctgcacacgacagagatctttccgagcctttttcatctagtgtgctgtgctgacccgctcccctggatgcctgcacactcatttggttctcccttttggtcacttttttccacttaccctggcagaaattcacgtggctgtcagtagtaattcagtgacctgctttcaaaaaatgttataaattaagcagcttttctgtgtatagcttttgggttgaactgagaagggctaagtgaagggagaagctatgttgagctcagagtcagaatgccctgccccagacattttgagatgtgaatttttcatttgttttgtttggtgacacttagagagaataaacattctgagataaaaatcttccttgggcaggccagcaaagatagaattgctttagagcaatttggcacttggtcttaatcttaatagtttggaactcatatgtgactaaggaaaaggatattgcaaaaagttgtgccaccctaggctatatgatataaacttagaaagtctatcaacgtgaaaggtgaagagacctctagagacatcggggacaaactccaaatttgggaaaggtccatccacatttgcaattgttagttaggcttgggaagtggagtcattggtggatgaggcaacttccaatcaccatctcgatttttatttccctaacttttaagattattttctatagaaaatcagtagtgctgaagttggagtcatttaattgatttgtgccaacctagggaagcatttactctcgagaaaagtttggtaaccattaatcttaccttagcaacatttcagtttaagcttatctctgactttccaaagacaactaaagatttctacagtctctcttataactgatccattttttcaaaagatgtccctttgggaaggaattctcatttttagaattttagtccagaggaagtatttttttttcagataggtgaaataggataagcagaaaattcttattttttactgttttagataccattgatgccatgcttattttaaaacaaaacacaataaaaacatgataccatctgatgagttgctttggttttactttttttttttttttttttttttttttttttagtttatacaagtttcttattaggtcagcaaattgtaaaacacataatttgccaaggcttttgaagccagcagatactgggtgaagttgctgtatgaatataataataagaaccgtttttgttcagcttgatgaaaaaactattcatgttctaaatgaaaatgtgaagatcatctaattctgacagaaaaccacctgtggacatggtcttgtttctttttatttcttctgttttctacaaaagatggcaatatttatttaaagtgctttaacaggatatcccagttaaagctttgacagactgtttatagttcacttctgcccaggggcaattaaaggcacattacaggataagcgagatgactccccggccacaggaggaggatgtgtgggtaggattattaatgttgaaatgaattatgatagagtgacatgtctgcaagagcaccatgggttagtaacttaacaagaattcatatgcagaaacccataattctcagcagttctttagggtaaatgaaactaaagtttagggagagagaacaaggagaatttgcaaagatatgtatgacagtatttaaaaatgttcttccagcacaaagacattaatcttcctttgtcaaaataattctttctgcatgaaaagttggcatggggctcccaggcttcaggtaagatgggagaaagggagcgtttctttttttttgtaccaaagtactcaatcttctgatcttccttgactttcacgacataggcatatgtctactctgaccagtttgtttcatttattgtggtaagatgtgcttgtcttgtgctttcctggtgcagaaaaggagctgcctcgctcatgcttggtggcctttttgttcctacacacagtggttctcgtacatggtggctaccacatcctggtgtttgtctatactgggagaatcaggcgttccaagtcatcttggctgccctagctctgagcttcaggggatatatgactcagaaatgctatgctttctggaatttggatatttcatttttatttgtttcttggtaaattctcttttgacttaggagaagctaactatttggaaaggtctctcagaactctaattacaaatatatggtaccttctttatattgatctcatttttaaatacctagtcctggaggaagagctaaatatgaatacagtgatgagctgtgtaggggatctcacaggaacacagtcagatttcaagttgaaaatagattcagttgataatacttagtactagattctcctgaatcgactttgggaattctgagtcaacctaaggactatattacaaaggatcagaccttgacttttaggccaggtgtagtggctcatgcctgtaatcccagcactttaggaagccaaggcaagtggatcacttcagtccaggaggttgagaccagcctgtgcaacacagcgagaccctgtctctaccaaaaatacaaaaattagccaggtgtagtgtagcacctgcctgtagtctgagctactgaggaggctgaggttggagaatcaactttaaccccggatatggaggctgcagtgagctgtgatcatgccagcctgggcaaggagcaagaccctctctcaaaaacaaaaacaaaaaagacacagaacttgacttttaacaggaggcatagtaatagcaagcataagattgttttaacatagcatttaagataatttacgcatttagaaaattaattctggctggttgtagtagcttatccttaatcctaaccctatgagaggccaaggcaggaagatcacctgaggccaggagtttgagaccagcctaggcaacatagcgagacccctgctctctacaaaaaattttttttaaaaaacatagctgggcatggtgacacactcctgtagtcccagctactcaggaggctgaggcgggaggcttgcttgaggccaggagtttgagggagctgtgatcacgcccctgcactccagcctgggcaacagaatgaggccctatatctaaaaaaaagaaaaatggacaagaaaattctatactgattgaagcccagctaaatagaaaaaaaaaaattctaataggccattttaaagactttggaaaaattcttagctagagtaaaacagaagcaatcctttctttcctggttctcacatctccattctcaccttcattccccttcccctccatttgtttcaagtatttttcttttctatgtgtgtctttatgtaaatttaaatttacctacaagatattatgatattaagatatttcattctgcttcctgttttgtcacttgttctttaagatccaagtccttggctccatgtgcatctaatccttgccataagccctgcatcgtacttcatattcaccatattgaactattcaccctcaagtagtcactattaaatgtcacactgttgtagcgactacaaatgcaagctcagtaactgaaaagataacattaaattttgttttttaattggtttcctgtgtcaatttcatgtttcgggaatttgtatggacagatagacaccagagagatatgcgtatttcacctgcatgcttgaggctagagaaacatgatttattcagaactatttcaaatactgtaactaacctggtaattttgtttaggaaaacattaaattcggaatagaaggcaattcagaatacctgtctgttatctttgtcttgtcatttttgagatactcagttcctggaaaatattatgataatccatcttgctatgtagtatttcaagttatatgttgagcctctgagcttgcagagtgaacatttctattcatagacagtgctgttgacatcagtggggagatggcacaagctttgtgccctaggaaagtttaaaagctagaacattacactgcaaaccctatgtcaggaaactttgttgcagcaactaggcaaggaaaccctaccactgtacccataccttgttttagtagaattatgtttctttgctaagaagtctggtgactctcacaccccatctcagcactttcctggattccaaggccctggtgccctgagcacacaacttcccaggttccttttattgttcctgataagaactcgaattagaggcagcgtctggtactcaccaggggtgtggtcccatgggtgacattcttgctccatcatttcttacccgggtaaccttgagtatggcgcctaaatcctctcttcctttcaaattgcctggtctgtaaaatggatgcagtgaatggtagctatgccacaggtgttttgtgtgagaattaaatgagaggagttatatcaataacacttagaggcatgcggtgcctatagtgagggcttgttttatgttgtcgtttaaccctttctttctcagccctcccccactccacatcccctcccactggcaatgtacaaattgcagcttcctgcctctttcctgctatctcgctccctggatgacatccctgcgtttccacctctctctcccctaatcttagctgttttcaccctttcccctaatcttagctgttttcaccctttccccacagcattgccttgacagttcctcagtgtcccatcccctcttcccatggacaacaccacaaacctgcgcacacggcctgttattattcctcctgtttcacctgtgtccattctgtctcataaaggacactgtaggctctgaacagctaaggcctttcttattcttttgtcccatggaaaataatccctccagatagcaataccaggaatagtgccttttctaacccactggtttccttttgagcttacagccaccaaatcttatatctgtttgtttctgttcccctctctgcattgactgctagagagatcagagtcaagcaggaggttacatctagctggggcactgtgctttatgctggtgtttcgtgtgcaaatctcataccatcttcatgttacagttgttccttagtgtccatgggggatttgtttcagaacccgcaaggacaccaaagtccagggatgctcaagtccctgatataaaatagcattgtgtttgcatataatctacacacatcttaccatataattttttttattatttgtatacattcgtggggtacaagtgtaattttgttacatggatgtattgcatagtggtcaaagtcgaggctgtgagtgtatttatcgttggaataatgtacattgtacccgttcattcctgtatactttaagtcatctctagattacttataatagctaatacaatgtaaatgctatggaaatagttgttatattgttaggggataatgacaaggaaaacacctatacatgttcaatacacagcaattatttttttctgaatatttttgatctgccattgattgaatctatggatgtggaacccacagatatgggacccacagatgcagagggccaactgtgtttattttttccaaatttgtttccctgttatgactcttctttatacacatttttaaactctgttgtcttgtatttgttttctgatcatcttacgtccttttggaaaccaagtggggcataaatagtacatgtttgcatttgaggcaacacagaggcatcgcaggagctggagacagcaaagttcaaagccagtccaccacttacctacagagtggccttgggcaagttacctccattttctgtctccattctcgagcctgtctagagagagaatgaacctgcctcccgaggtgatggtgctgttttaatgaaataatgcatgtgaaatgtgaagtgccactgtccctggcatggagatgctgtccttagatattaggtccatcttgtatcttctagtgtatctttaaaaattaaactatactggcttcatgcctgtaatctcagcactttgggaggccaagaccggcagatcacttgagtccaggagttcaagaccaacctgggcaacatggtgaaaccctgtctctacagaaaatacaaaaattagtggggcttggtggcacgtgcctgtagtcccagctgcttgggtagctgaggtaggaggatcacttgagcccaggaggctgaggctacagtgagctgtgattgcaccaataccgatcagcctggtatgacagagcatgactctgtctcaaaaaaaaaaggaaaaaaattaaactatactgataaatatttctaaagtaattgatgaaaacatatatatgacacttagcaggtgttgatcaattccagtgcgtgcatgagctgctttgcactgtggctacagcactcagcagtttgcttagtgagtagatggccatagctcactttaggtatctggagaataatgctcattcctgtctccagctttgtaaaattgcctaatagacggaaggcattaaaatatgaagatgggattatatcttatgaagctgcttggaatgggttttccctcttaacaaataatttctgatcatccatatcccttaagaacaccggatttctgggggccagggaggtaagattctatctgacaaagccttcctggtgtcaaccacttgccatctgttggtcagtgctggccctgctgggtctatagaatgagcttctttgtctgacgctcctgttgccatccctttctccatcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctacttttgttttctctcttatttgtcactatggacaacagttacactttaaagaaaatggagcagactcaaagcactttcctctaataattgcacaccatatgcacttcgtgtgaagaagccaggaatcattacaatggagaagaaagaacaagcaaactgagttaaatagttcacaaacaatcacatggacaatggggaggaatcttccagaatgcatcagtcagggtctagcggcatttgagtgcggatgctgtaaggggaattcgttcacaaatgtactgataccacagatgtgggcaggggctaggagagcaacagggtgcagcctgaaggcacctggaaggccgcctggagggggacagtcaggaaagcaggagcccttgagaggagcactagcctttgatgagaccactgccatcgaaggagacctcacagggagggagccaagggtaaaccctaactttgtttccccatttctcctatctctgcctaggggtcctcactggcagaaccaaccagaagctggaggacaagggagctc

SEQ ID NO: 3328 - DNA, 1528 bp, Homo sapiens
  Genbank Accession No. U22662
cagtgccttggtaatgaccagggctccagaaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccaggcgttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtggagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 3329 - DNA, 3239 bp, Homo sapiens
  Genbank Accession No. U22961
gagctccatcctgtgctcagggggtagacgagggccccaatgggctgaagctcatctcggaagtgattggggagcgcctcggcatccccatgagtgtgctgatgggggccaacattgccagcgaggtggctgatgagaagttctgtgagacaaccattggtgagagccccctggcacctgcatacacagtgcatctagttgcatcccctccccaaactgccccaaccccacttagccatctctttcccataaggcagagaaaggaaaatacaagcatcagaggtgaaggaggctgggacacccccagggaaggggcttcagggccttgcttagggaaacacagtgatgagccctccctcagagttggtgcagtggcacacctgtggtcccagctacttaagaggctgaggtgggaggatcgcttaagcccaggagtttaagtccagcctgggcaacagagagagactcccatctctataaaataaatattttttaaaaagagtccttccctcaaagccttgccccctcctcactttaggctgcaaggacccggcccaggacaactcctgaaagagctgatgcagacaccaaacttccgtatcacagtggtgcaagaggtggacactgtagagatctgtggagccttaaaggtgagaggggcacagaggcagctatggggtgaggagaaggccccaaaggaggtctggctgagctctgcaaggctgcaggtactccaggctctcactattgagcagtggttcccctttcctaccatgtcccatgcatataggaggagctgcagaagcaaggccagggccattcaggcggctgattattcatcatcagaccgtggacccccttgctcctgtcccattttagccccgtgtgggactccccaccctctggctccaggaggtggtcagggggacaaggagatgcccaggctaatgggagacaaaacatccttgacacccagacagactaatggccagaactatggatcctggacagctgttgacttagggctttacaatggaatggtcaatagatgggaagatcaactagagagaagagtggttttcagaaaatgtcctcgaggagggagtatggggcagggcttaagaaagggggtgcagcaaggggggaaaccaagaggcggaagtaggcttctaaaaggccacacactatacctctcttctgcagtgggtgtcacggctgatgaaatgagtatgagggggctccacatggggcctataggagggggtctttttctcacctatgacctccactccttcaagaatgtagtggccgtgggggctggcttctgtgatggcctgggctttggcgacaacaccaaggcggcagtgatccggctgggtctcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaaggtgggccccgggagaagggagaacagaggggcggctctgtaggcatccaggtagaggtgcttggcgggaggcatctctggagcacaaacattaagactgttgtgcacatccccatccctcttttcctcccaagaccccactcccatctgagctccagtctctccaccccctactgacaacccagctgctcccttttccaagctttaccctgaccagtcatgagtggatattctgaacctgtttcatactgtcttcttctaggagtctttctcagaccagcacagctctgctctgatcagcccaatcacccccgctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgggagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcttgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaa

SEQ ID NO: 3330 - DNA, 3134 bp, Homo sapiens
  Genbank Accession No. U24266
tccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtgatgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggctgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgtaaagtgttgggtcttcctccaggatgcctgcatgggaccccacccggagctggtgtggccattccccgaagtgccactggcccatggatgggggtgggtgctggtgcacctgggctgggtgtgggttctgtgtccttccaggatctgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 3331 - DNA, 1313 bp, Homo sapiens
  Genbank Accession No. U24704
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 3332 - DNA, 921 bp, Homo sapiens
  Genbank Accession No. U25182
gcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattacca

SEQ ID NO: 3333 - DNA, 562 bp, Homo sapiens
  Genbank Accession No. U25789
gccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgctggcattgttgtaaacgaacaagttaagggcaagattcttgccaagagaattaatgtgcgtattgagcacattaagcactctaagagccgagataacttcctgaaacgtgtgaaggragatgatcaggaaaagraagaagcccaagagaaaggtacctgggttcaactaaagcgccamcctgctccacccagagaagcacactttgtgagaaccaatgggaaggagcctgagctgctggaacctattccctatgaattcatggcataataggtgttaaaaaaaaaataaaggacctctgggctaccaaaaaaaa

SEQ ID NO: 3334 - DNA, 1902 bp, Homo sapiens
  Genbank Accession No. U26173
gcccctttctttctcctcgtcggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggacgtgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgggaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacaga

SEQ ID NO: 3335 - DNA, 1897 bp, Homo sapiens
  Genbank Accession No. U26726
gacgagagaaagcgagtgtccctctcgcgccccaggccggtgtacccccgcactccgcgccccggcctagaagctctctctccccgctccccggcccggcccccgccccgccccgccccagcccgctggcgccatggagcgctggccttggccgtcgggcggcgcctggctgctcgtggctgcccgcgcgctgctgcagctgctgcgctcagacctgcgtctgggccgcccgctgctggcggcgctggcgctgctggccgcgctcgactggctgtgccagcgcctgctgcccccgccggccgcactcgccgtgctggccgccgccggctggatcgcgttgtcccgcctggcgcgcccgcagcgcctgccggtggccactcgcgcggtgctcatcaccggctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcgtgctagagttcaccaaggcccacaccaccagcaccggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggagcccagcgggggacatgccatatccgtgcttgggggcctatggaacctccaaagcggccgtggcgctactcatggacacattcagctgtgaactccttccctggggggtcaaggtcagcatcatccagcctggctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttct

SEQ ID NO: 3336 - DNA, 1017 bp, Homo sapiens
  Genbank Accession No. U26727
gagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatataagccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaattattttcattcattcactc

SEQ ID NO: 3337 - DNA, 2583 bp, Homo sapiens
  Genbank Accession No. U27328
gttcccacttcctcccgccccaggaaacctgccatggcctcctggtgagctgtcctcatccactgctcgctgcctctccagatcttcagttgcttcaggccactttgaatgtatatgagccggtcgtaggggatatcgatggcttagcttgggctcagaggcctgaaaatcgcccccaccaatcacctgtttcccccaatctaccctcctgaaggtcactgacaaagacttcattgtctcctaggagaggctgccatatatcagggctgacgtaattccatcttaatatcagttacattataaaaatttacctcgtgcctgaggccccagagcccaagggtgcaaagcagtaattagtcaaagttcaacttcccctcccactctgggctcaggctgtccctgagggcctgtgttttgagtctctttccagaaccttggtgtgaacttaggtcttggcgtcgggatcccttttcgtcacactcaggtgacctacaggctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaattccagcactttgggaggctgaggtaggaggattgattgaggccaagagttaaagaccagcctggtcaatatagcaagaccacgtctctaaataaaaaataataggccggccagca

SEQ ID NO: 3338 - DNA, 1823 bp, Homo sapiens
  Genbank Accession No. U27460
cccccaatttcccagctgctaaaggaagaggaaggtacctgtgcgtgcacgcagacgggaagggctggggaagcgggaggactgagaaaaccagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcctgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaacaaaacctacaatacagatgtccctcttgttttaatgaactcttttaacacggatgaagataccaaaaaaatactacagaagtacaatcattgtcgtgtgaaaatctacactttcaatcaaagcaggtacccgaggattaataaagaatctttacggcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatcaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgttgacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagctttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagatagtgtctggaaaccttcgcatcttggaccactgaaatgaaaaatactgtggacacttaaataatgggctagtttcttacaatgaaatgttctctaggatttaggcactaaaaggtactttactatgttactgtaccctgcagtgttgatttttaaaatagagttttctgcagtatgcttttagtctaagaaaagcacagatggtgcaatactttccttctttgaagagatcccaaagttagttactcttaagtgc

SEQ ID NO: 3339 - DNA, 3410 bp, Homo sapiens
  Genbank Accession No. U27699
gtaccggttcggaattcccgggtcgacccacgcgtccggaaggctacagagagagccaggttttggtgccatgcacacagggaaacttagagttcagagagggggtgtgatttgcctgacctcacacagcaagttagagacccagctccacgactcattgtcttgctgcccagagctgctggctcccctgtttactctgagctgatcgatcaccttagcacacagctggctaggagagaaccatgcagtcacttcggccacacctgcccgttgacccttgctacctcggcaggctttgatcccttctgacctggaggccagaggctaggctgaggtcactcagcagacatcaaggacctgggcagatgggccggctgggatggtggcgagctgtacagataaaaagggacatgaaaatgaaaagcccgagcctgagttttcatcacggttccactcctgagtggtcttgggtgaatcacttcatctgccaaggcctggatttcctcatctgcaaactcagaaaactaaggctttggccctcgtcatcctgcccacccagcggggcttcccaacccaccacacagccatggacgggaaggtggcagtgcaagagcgtgggcctcctgcggtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcacgtcatcacccctgactccagtctgccacagcccaagcaacatccctgcttggatggcagtgctggccggaactttgggccctccccaacaagggaaggactgatagccggggagaaggagacccatttgtagggtgtggccagagcgaggcggctcctaagccgggaacctaggtcagggccaccctccattctcagcggacagcctctgcctctgtctcctgccacaatcctgctgggaactctggagagccacaggcacccccagctggaggccagactcctctcttgtgctagctggagcagctccttcccctttgctgataacaccaccactgggacgtgccatgttgggacgccactccctgtggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatcctccgaatgtgctccaggcgacaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgcca

SEQ ID NO: 3340 - DNA, 2173 bp, Homo sapiens
  Genbank Accession No. U28833
gaactatagttgaaggctgctgccaatacaacaccactgtgaaacagaatggtgtatgccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatactttttttaactgcattctataataaatgggcacagtatgctccttacaaaaaaaaaaaaaaa

SEQ ID NO: 3341 - DNA, 22484 bp, Homo sapiens
  Genbank Accession No. U29953
  unsure (1)..(22484): n = a or c or g or t
gcggccgcagggtggactgtgctgaggaaccctgggcccagcaggggtggcagcccgcgcagtgccacgtttggcctctggccgctcgccaggcatcctccaccccgtggtcccctctgacctcgccagccctcccccgggacacctccacgccagcctggctctgctcctggcttcttcttctctctatgcctcaggcagccggcaacagggcggctcagaacagcgccagcctcctggtttgggagaagaactggcaattagggagtttgtggagcttctaattacacaccagcccctctgccaggagctggtgcccgccagccgggggcaggctgccgggagtacccagctccagctggagacagtcagtgcctgaggatttgggggaagcaggtggggaaaccttggcacagggctgacaccttcctctgtgccagagcccaggagctggggcagcgtgggtgaccatgtgggtgggcacgcttccctgctgggggtgcagggggtccacgtggcagcggccacctggagccctaatgtgcagcggttaagagcaagcccctggaagtcagagaggcctggcatggagtcttgcttcttgcaaacgagccgtgtggagagagagatagtaaatcaacaaagggaaatacatggtctgtccgaggatgagctgccggagagcaatggtgaaagtgaagtgggggagggggcggggctgggaggaaaagccttgtgagaaggtgacacgagagcacggccttgaaggggaagaaggagggcactatggaggtcccggcgaagcgtggcctggccgaggaacggcatgtgcagaggtcctgccgaggagctcaagacaagtaggggacggtggggctggagtggagagagtgagtgggaggaggagtaggagtcagagaggagctcaggacagatcctttaggctctagggacacgataaacacagtgttttttgtcttgtcaagtgtgtcctttttatttttttgaaagagtctcgctctgtagcccaggctggagtgcagcggtgcgacctcggctcactgcaacctctgcctcccgggtccaagcaattctcctgcctcagcctcccgagtagctgggattacaggcacccgccaccacgcactgctaatttttgtattttagtagagaccgggttttgccatgttggtcaggctggtctcgaactcctgacctcaggtgatccgcccgcctcggcctcccagagtggtgtgagccactatgccctgcagcacttgtcaagtctttctcagcgttcccctcctctccactgcagctcccagtgccccagtctgggcctcgtcttcacttcctgggatccctgacattgcctgctaggctctccctgtctctggtctggctgccttcactgtaacctccacccagcaggtacctcttcagcacctcccatgaacccagcagaataccaagccctggggatgcagcaacgaacaggtagacgctgcactccagcctgggcgacagagcaagactccgcctgaagaaaaaaaaaaggaccaggccgggcgcggtggctcacgcctgtaatcccagcactttgggaggccgaggtgggtggatcatgaggtcaggagttcaagaccagcctggccaaaatggtgaaaccccgtctctactgaaaaatacaaaaattagctgggtgcagtggcgggcgcctgtagtctcagctactcaggaggctgaggcaggataattgcttgaccccaggaggcagaggttgcagtgaaccgagatcacgccactgcactccagcctgggcgacagagcaagactctgcctcaaaaaaaagaataaaaataaaaaaaaggaccagatacagaaaacagaaggagacgtactatgaaggaaattggagagcttttgggatactgagtaactcagggtggcctttcccaggggacatttagctgagagatagacggtatgaagacctgaccgttcagaaacaggggaagaggcagcagcccgggcaaaggcctttggggcaggaaagggcttggatcactggagaagcagaaagatggccagtgtgaccagagtgtgacaaagtcagagaaaaccaggaagatggagctggagacacaggcggggccagatcacgagggtcctcgcagaccagagcaagggtttggattttattccaagtatgaagggaagctgctgaagtgtgttttcctttacaatttgtagttgaaatataatatgcaaagtacacaagtcttaactatatgtaagcttaatgaatgtttccatgaaccaaataccgctgtgcaaccatcaccagctcaagagacgaacccttctccctcctcctgactgccagtaacatagtggttcagctcaagaaacagaactcttctgacttcccctaacatagcgggttttcttttttgttttgttttttgttgttttttaagagacaatgtctttattatttttatttttttttatttttgagacggagtcttgctgtcgcccaggctggagtgcagtggtgcgatctcggctcactgcaggctctgccccccggggttcatgccattctcctgcctcagcctccctagcagctgggactacaggtgcccgccacctcgcccggctatttttttgtatttttagtggagacggggtttcaccgtgttagccaggatggtctcgatctcctgacctcgtgatccgcccacctcggcctcccaaagtgctgggattacaggcatgagccaccgcgcccagccaagagacacggtcttgctctgtcgcccaggctggatggagtgccgtggtgcgatcacagctcgcggcagccttgacatcctgggctcaagcaaccttcctgccttggcctcccaaatgttgggattataggcatgagccactgtgcttggcatctattcatctttaatgtcaagcaggcaattgaatatttgatcagggatagaattgtctatttgggggtatgcagatgtgcttcatgtcatggaactgggccgggcgcggtggctcatgcctataatcccagcactttgggaggccgaggcaggcggatcataaggtcaggagatcgagaccatccgggccaacacggtgaaaccccgtctctactaaaaatacaaaaattaggcaggtgtggtggtgcgtgcctgtagtcccagctactcagggaggctgagacaggagaattgattgaacctgggaggcagaggttgtagtgagccaagatcgcgccactgcactccagcctgggcgacatgagcgagactccgtctcaaaaataaacaaaaaaaagtcatggaattgatggaaattgcctaaggggagatgtagaagaaaaggggtctcaggatcaagccagcagagaaggcagaaaaggtaaggtgtgtgaggtggcagaaaaagggaagagtgtggacagtgagggtttcaaggaggaggaactgtctactgcctcctgccaaggacggaggtgtccactgccagttgacataaggtcacccatgaacttggtgacaggaatttcagtggagaagtggccacagacacaagtctagaattgaaatgggagccgaggcagcgtagacaaaagaggaaactgctccttccagagcggctctgagcgagcaccgagaaatgggcagtggctttaggggatgtagcgtcaaggaagtgtcttttaaagaagtcgggggccgggcacggtggctcacgcctgtagtcccagcactttgggaggccgaggcaggcagatcacttgaggtcaggagttcgagaccagcctggctaacacgatgaaaccccgtctctactaaaaatacaaaaaattagctgggcacggtggctcgtgcctgtaatcccagcactttgggaggcagaggtgggcagatcacttgaggtcaggagtttgagaccagcctagccaacatggtgaaaccccatctctactaaaactacaaaaattagccgggagtggtggcacgtgcctgtaatcccagccagtcaggaggctgaggcaggagaatcactggaatcctggaggtggaggtggcagtgagccgagatggtacctctgtactccagcctgggggacagagtgagactccgtctcaaaaaaaaaagaaggtggggaaggatctttgagggccggacacgctgaccctgcaggagaggacacattcttctaacaggggtcggacaaaagagaactcttctgtataatttatgattttaagatttttatttattattattttttatagaggcaagcatttttcaccacgtcacccaggctggtctccaactcctgggctcaagtgtgctgggattatagccatgagtcaccacacctggcccagaaactttactaaggacttatttaaatgatttgcttatttgtgaataggtattttgttcacgtggttcacaactcaaaagcaacaaaaagcacccagtgaaaagccttcctctcattctgatttccagtcactggattctactcttgggatgcagtgtttttcatctcttttttgtatccttttggaaatagtattctgctttaaaaagcaaatacaggccaggtatggtggctcactcctgtaatcccagcactttgggaggccgaggcaggtgatcacctaaggtcaggagttcaagaccagcctggccaatatggtgaaaccctgtctgtaccaaaacacaaaaacaaaaacaaaaacaaaaattagccgggcgtggtggcgtgctcctgtaatcccagctactcaggaggctgaggcaggagaatcgcttgaacctgggaggcagaggttgcagtgagccgagattgtgccactgtactccagcctgggccacagagcaaggttccatctcaaacaaaacaaaacaaaacaaacaaaaaaacaaaacaaaagctaatacaaacacatatacaatagacaaaactgtaaatattttattatttttattttttttagtagagacagggtttcaccatgttggccaggatggtctcaaactcctgacctcaggtgatccacccacctcagcctcccgatagttaggattacaggcatgagccaccacacccggcctaaaattgtaaacgttttagaagaaagtatagatgaatcccttcgtgatctcggggaagaagagattttttaaaaaagataccaaaagaagcacaaattataaaagaaaagattgaaaatgttggtgttaaaattaaaaacttgttttaaaacaagcttgtgtaacccatgacccacaggctgcatgtggcccagaaaagctttgactgcagcccaacacaaattcgtaaactttcctaaaacattatgagattttttttgagattttgttttgttttgttttttgtttttttagctcattcggtatcattaatgttagcatattttacgtggggcccaagacaattcttcttccaatgtgtctcaggggagccaaaagattggacacccctgccataaacatgaaaagacaatggccgggcacggtggctcacgcctgtaatcccagcactttgggaggctgaggggggcgggatcacctgaggtcaggagtttgagacaagcgtgaccaatgtggtgaaaccctgtctctactaaaaatacaaaaattagccgggcatgctcgtgcacacctatagtcccaactactcagcagggtgaggcaggagaacctcttgaacccgggaagcggaggttgcagtgagccgacattgcacccctgcactccagcctgggtgacagagtgagtctccactggaaaaaaaaaaaaaagaacagtgtgatacattgacctaaggtttaagaacatgcaaactgatactatatatcacttagggacaaaaacttacatggtaaaagtaaaaagaaatgtacgaaaataataaaaatcaaattcaagatggtggttatggtgacgggaaagaactgaggcggaaatataaggttgtcactatattgagaaatttttctatctttttttcttttttctttttttgagacggggtctcgctctgtcgcccaggatggagtgcagtggtgtgatctcagctcactgcaacctccgcctcccaggtttaagtgattctcctgcctcagactcccaagtagctgggactacaggtgcgcgccaacacacctgggtaattttgtttgtatttttagtagagatggggtttcaccgtgttgactaggctggtctcgaactcctgacctcaggtgatcccccggcctcggtctcccaaagtgctgggataacaagcgtgagccactgcgcccagctttgtttgcatttttaggtgagatggggtttcaccacgttggccaggctggtcttgaactcctgacctcaggtgatgcacctgcctcagtctcccaaagtgctggattacaggcgttagcccctgcgcccggcccctgaaggaaaatctaaaggaagaggaaggtgtgcaaatgtgtgcgccttaggcgtaatggatggtggtgcagcagtgggttaaagttaacacgagacagtgatgcaatcacagaatccaaattgagtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggtaaagcagctccctggctgctctgatgccagggacggcgggagaggctcccctgggctggggggacaggggagaggcaggggcactccagggagcagaaaagaggggtgcaagggagaggaaatgcggagacagcagcccctgcaatttgggcaaaagggtgagtggatgagagagggcagagggagctggggggacaaggccgaaggccaggacccagtgatccccaaatcccactgcaccgacggaagaggctggaaaggcttttgaatgaagtgagtgggaaacagcggaggggcggtcatggggaggaaaggggagctaagctgctgggtcgggtctgagcagcaccccaagactggagcccgaggcaaggaggctcacgggagctgcttccaccaagggcagtcaggaaggcggccgccctgcagcccagccctggcccctgctccctcggctccctgctactttttcaaaatcagctggtgctgactgttaaggcaatttcccagcaccaccaaaccgctggcctcggcgccctggctgagggctgggatggaggacagctgggtccttctagccagcccccacccactctctttggctacatgagtcaaggctgggcgaccaatgaggttgtggcctccggcaaacaatgaccactatttaggccggcaggtgtatagggcgtgggggcccagctgccagtgctggagacaagggctgtccgagatgaaccctttctgctgcctgccaagccactgggaggggtaggtctcagcaggattcccagaaaccccgcccctgtccagcctaggccccccacccggtgttagctaacccaacgttagcccccaggttccgtggggttggggggcagggagtcctattcttggggctgctgcttctggggtgtggggaagtgcaactccacggcaccctgggctgactcattcagcttctaaagcttcaggaaacattgtttggggctgggtcaccatgggtgggccagagaggacccctcaatcccctccggagagccaggggagggggaggtgcccttccccatgctatctccgaggcccactgccatgtggctgaaggctgtgcggttctgggaagagggggaggtggcggtggaggctgtttgtctcctaactgggcttaatctgaaacacatgtattggcttgagttgatccgcctcacgtggaggcaagatcacaaaagcttctgtgtttcttgatgtgggcaattgtcagaaaataaggcctgaccttggcccagcagggagggtatctacctctccctgagccctcccccgcctgctaggacgagagcggggcttggatactgccctttggacaggatggcatcattgtctgtggctgcagccagccagcggtcgcctgctcagcccatgagcaaccactgtggacagggtattgcgtgtgtgctgaggggcgtccatgcagacccccacgcttgccctctcactgcccttgtagggttttcaatcatctctcctcttcccttatccagatggcttgaagtggaggattcagacttgccgttaatactctgggtccctgtgtctagctcggggccacctttggacccatgtcccttccctgccaggctccctcacctcacctcagcctacccacattgtgacaatcatctaccacctgatctggggtttgggcttagattctgtaggcaccaagactaaagtcgctccttcaagtccatttgaattgtgactttagtttccttaaatactatgccaggataatggccagggatggtggctcacgcctgtactcctggcactttgggatgctggtggatcacctgagatcaggattccaggccagcctggccaacacggtgaaaccccatctctactaaaacataaaaattaaccaggtgtggtggcgggcacctgtaatcccagctactcaggagactgaggcaggagaattgcttgaacccgggaggtggaagttgcactgagctgagatcgcgccactgcactttagcctgggcgacaagagtgaaactctgtctcaaaaacaaaaaaaactatgccgggatgagcctgtctcctcccttaatttcttacttgggccagaggaactagaactaacaacttctcttctagccttgcctcctgtgtacctcactgaatttttggtctctaataaaccagtctgcagaggctcaggggaggcaggctcctggcagctgggtggggctggccccagccgggtggagaccagctgtaggcctggatggtggtgaggcctctgtcttgcactgcagaaagcttttcctgttgtctacacgaaagttttctccctgcatgtcagggcagccacgtgcaagagcagctggctgggaacgcagaggtctgcggctcgaggcggggtttagaaagaaaaccaggctgcttcctgctgcccgtcctgccttaagctgagtaaactcaaaggcaatcttctttcatgcctcacgatattgtccagtggattatctgatttaatttgaaggacgagagccaacaatcacacaacgtcctcccaaattttctgatccactttgttctgggaagtcaaaaagtgcgtgtgctgtgtgggtggatgtttgtgtatataaatggataatgaaggatgatgtgttgggggccagggcaggggagacaacgctgttcagattctacatttttttttccttttttttttttttttgagatggagtcttgctctgttgcccagcctggagtgcagtggcgcgatctcagctcactgcaacctccacttcctggattcaagtgattctcctgccttagcctcccaagtagctgggattacaggcatgcgccaccacacccggctaatttttgtatttttagtagagatggggtttctccatgttggccaggatggtctcaaactcctgacctcaggtgatctacccgcctcggcctctcaaagtgctgggattacaggtttgagccactgcgcctggcctttttttttttttttgagatggagttttcactcttgttgcccaggctggagtgcagtggtgcgatcttggctcactgcaacctccacctcccaagttcaagtgattctccagccttagccctccaagtagctgggactacaggtgtgtgccaccatgcctggctattttattttattttattttatttatttatttttgagactaagtcttgctctgttgcccaggctggagtgcagtggcataatcggctcactgcaacctctgcctcccaggttcaagtgattctcctgcctcagcctcctgagtaactgggattacaggggcctgccaccacgcctggctactttttgtatttttagtatagatggggtttcaccatgttggccaggctggtctcgaactcctgacctcaggctatccgcctgcctcagcctcccaaagtgctgggattacaggcatgagccactgtgctcggtagttgttttattttaatagtaggttattttatttccattttacaagagaaaaaatggtgatttaaagagctactaagacacagcactgagaccatgtgtgatggcatgcgcctgcagtcccagctactcacgaggctgaggcaggaggatcacatgaggtcaggagttccaggctgtggagtgctatggttgtgtagtgaatagccactacactccagcctgggcagcacagcaagatcttgtctcccaaaaaaaaaaaaaaaaaaaaatttcaaatgtgaacccaggatctctgaccctaggccctgcactcctaaccatgggaggaagagctcttgaaagggaactgtgggagaagggaatgagctgccttgtgaggccacagaagtccaaagacagcttgagaatttggagggacagcacgtgccggactgggtgcctctatgcttggtatccggtgattccatggaggagacctgggttctgccccattctcctgggaggggttgcccaaagtcttatcaccggagtgggtcagctgcctccaggacaaagctttagcatacacttgtgctgggccatactccacgtggagaagccctgctggggctggggccccactgctctggatctttaaaagctattggttcaggggccaggtgtaatggctcacacctataaccctagcactttgggaggctgaagcaggtggatagcctgaggtcaggagtttgagacaagcctgatgaacgtggtgaaaccccatcgctattaaaatacaaaaaattagccgggcatggtggcaggtgcctgtaattccagctacttgggaggctgaggcgggagaatcgcttgaacccaggaggcggaggttgcagtgagccaagatcgctccactgtactccagcctgggcgacagagccagactctgtttcaaaaaataaaatataaataaataaataaataaataaataaataaataaaagctttaggcttaaaggagggtcccctgacgcagacagtggaacaaaagcacaagcttatggtatgactgtgggccctgaggcagggggaggggcgggagaaccttgctgggagggatgggccatcaagctgagggtccacttctgggggcctggaggggtgaggggtggtcgctgcagggggtgggggaaagtgactagccctgcccaacccctgggtcctggctggggtggccaggaaggggtagcggggcagtgcagtgtcgggggagagcggcttgctgcctcgttcttttcttgcaggccccaggatgcaggccctggtgctactcctctgcattggagccctcctcgggcacagcagctgccagaaccctgccagccccccggaggaggtcagtaggcaggcggggagggcgtggtcagcattccccgcccctccttggcaggcagcacgggaaacaggacagggaacccggacccaggttccaggccaggcttgggcctttatttctctagggctggagtttctccagcagcaaaacagagagaaaatgtcttgccttgcctttcaggggatggagtagggacatgaataagatcccaaaagagtaaaaatctgaagcacttttaacaagtccagggcaattctcctgcctcagcttcccaagcagctgggattacaggcatgcaccaccaagcccggctcattttgtatttttagtagagacggggtttctccatgttggtcaggctggtctcgaactcccgacctcaagtgattctcctgcctcggcctcccaaagtgccgggatgacaggtgtgagccaccgcacctggccaggatcttttctcattaccttgtcttcctagtgggggctccactgagcaggtcatgttcccggacatttgttcggatactgaccaggctgtggcagggagtgagggtatggagtgacctctctcctgcccagaaagggcgcagctgggttcccaaggcagatacaggcacatggagggaagcctgggccatatgagtgttatggggtgagtgttggcggaggcccacccttgagggacaagagcagctgggcatcttggcgagagccctggactttcgtgaggtcagagtatgaattctgcgtctccctcttcctagctttgtgaccctagacaacccttacctcagtctttgcttccttgcctatgaaatgggataaaaacacccattctacagggccatgtggccactcatttatttctcatctaccaaacacctactcgacaggggctggcaatgggcggaaataaaaactcagttctgccgggtgcggtggctcacacctgtaatcccagcagtgtgggaggcggagcaggacgatcccttgaatccaggagtttgagaccagcataggcaacatagtgagacccctgtctctacacaaaagcaaaaattaccaggcgtggtggcaagtgcttgtggtactacctacttgggaagctgaggtgggaggatcacttgagcccaggagattaagactgcagtgaggggccgggcgcggtggctcacgcctgtaatcccagcactttgggaggtggaggtgggtggatcacgaggtcaggagatcgagaccatcctggctaacacggtgaaaccccgtctctactaaaaatacaaaaaattagctgggtgtggtggggggcgcctgtagtcccagctactcgggaggctgaggcaggagaatggcgtgaacccgggaggtggaggttgcagtgagctgagctcgcaccactgcactccagcctgggcgacagagtgagactccgtctcaaaaaaaaaaaaaaaaaaaagaaagaaagaaaaactgagttcttttttttaactttctttttttagagacagagtctcactccatcacccatgctggagtacagtggtgcgatcttggctcactgcaatcttggcctcctgagttcaaccaattctcatgcctcagcctcccaaatagctgggaccacaggcacgtgccaccacgcccagctaattttttgggtatttttagtagagatggggcctcaccatgttgctcaggttggtctgaaactcctgagctcaagtgatccatcttcctcggcctgccaaagtgctgggattataggcataagccactgcacctagctcccaatttttatatttatatttatttttatttacttatttattttttgagacagggtctcactctgtcacccaggctggagtacagtggcactatctcagctcactgcaacctctgcctcctgggttcaagcgaatctcgtgcctcagcctcctgagtagctgggattacaggcatgcaccaccatgccccgttaatttttttgtatttttagtagagacgggtttcaccgtgttgcccaggatggtctcgaactcctgacctcaagtgattcacccacctcagcctcccaaagtgctgggattataggtgtgagccactcggctgatggtttttaaaaagtgggtcatggggctgggcgcggtggctcatgcctgtaatcccagcactttggtagaccgaggcgggtggatcacaaggtcaggagatcgagaccatcctgcctaacacggtgaaaccccgtctctactaaaaatacaaaaaattacccaggcatggtggtgggcgcctgtagtcccagctactcgggaggctgaggcaggagaatggcgtgaacctgggaggcggagcttgcagtgagccgagatcacgccaccgtactccagcctgagcgacagagcgagactccgtctcaaaaaaaaaaaaaaaaagtgggtcataggtttcggcttataggtcacaagtgtttaaacctggccatgaggccaggcgcagtggcgcatgcctgtaatcccagccatttgggaggctaaggcaggaaaatcgcttgaaccggggaggtggaggttgcagtgagctgagatcgcgccactgaactctagcctgggtgacacagtaagactctgtctcaaataaaaaaaaaaacagctgatctctcttctgcgctgtctctccacagagagctcatgcgtgatcagggagtaaaactcattcccgttttaggccaaacacagaaaaattaggaaggacagccccaaggggccagaaccaccaccctacacaaagccgtgaggagacagtccctgtgcatctctgcgagtccctgaactcaaacccaagacttcctgtctcctgccagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggtgagtgctcagatgcaggaagccccaggcagacctggagaggccccctgtggcctctgcgtaaacgtggctgagtttattgacatttcagttcagcgaggggtgaagtagcaccaggggcctggcctgggggtcccagctgtgtaagcaggagctcaggggctgcacacacacgattccccagctccccgaaaggggctgggcaccactgacatggcgcttggcctcagggttcgcttattgacacagtgacttcaaggcacattcttgcattccttaaccaagctggtgctagcctaggttcctgggatgtaactgcaaacaagcaggtgtgggcttgccctcaccgaggacacagctgggttcacaggggaactaataccagctcactacagaatagtcttttttttttntttttttnnnctttctgagacggagtctcgctttgtcnccaaggctggagtgcagtggtgtgatctcagctcactgcaacctctgcctccctggttcaaggaattctcctgcctcagcctccagagtagctgggattacaggcacctgccatcatgcccagctaatttttgtatttttagtagagacggggtttcaccatgttgcctaggctggtctcaaactcccgggctcaagcgatccacccgccttggcctcccaaagtgctgggattacaggcgtgagccaccgcgcctggccagaataatcttaagggctatgatgggagaagtacagggactggtacctctcactccctcactcccaccttccaggcctgatgcctttaacctacttcaggaaaatctctaaggatgaaaattccttggccacctagattgtcttgaagatcagcctacttgggctctcagcagacaaaaaagatgagtatagtgtctgtgttctgggagggggcttgatttggggccctggtgtgcagttatcaacgtccacatccttgtctctggcaggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagagtgagtcgcctttgcagcccaagttgcctgaggcatgtgggctccatgctgcaggctgggggggtcttttttttttttggggaaagacggagtctcgctctgttgcccaggttggagtgaagtggcgtgatctcggttcactgaaacccccacctcccgggttcacaccatcctcctgcctcagcctcccgagtagctgggactgcaggngcccagctaatctttnttgtatttttagcagagacggggtttcaccgtgtttgccaggatagtctcgatctcctgacctggtgttctgcccgcctcgacctcccaaagtgctgggattacaggtgtgagccaccgcgctcggcccgtttctaaacaatagatcatgtgtgcccaggcctggcctggcactggtgtggaggaagggcccgtgagcccaaagaggctcagaaagaggaagtgggctgcaggagacggtgggaggggcagggagggcagtggcgcgatgtggggaaatctgctgcccccctggccagtgcctggggatgccagcagaagtcctggcaagtcacaggaagatgctggctgggaagtcagggcctgctgagcgctaaaccagaacccgagcctggcaggctctcaaagacgggatgcttgtcgtcgagtctcatacgctaacctctgctccgcctcttctcagagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaagggtgagcgcgtctccaattctttttcatttattttactgtattttaactaattaattaattcgatggagtcttactctgtagccctaactggagtgcagtggtgcgatctcagctcaatgcaacctccgcctcccaggttcaagcaattcttgtgcctcagcctcccgagtagctgggattacagggatgtaccaccactcccggctaattttttgtatttaatagacatggggtttcaccatgttggccaggctggtctcgaactcctgagctcaggtggtctgcccgcctcagcctcccaaagtgctaggattacaagcttgagccaccacgcccagccctttttatttttaaattaagagacaaggtgttgccatgatgcccaggctggtctcgaactcctgggctcaagtaatcctcccaccttggcctcccaaagtgctgggattacaggcatgagccaccgcgcccggcccttttacatttatttatttattttttgagacagagtcttgctctgtcacccaggctggagtgcagtggcgcgatctcggctcactgcaagctctgccttccaggttcacaccattctcctgcctcgacctcccgagtagctgggactacaggcgcccgccactgcgccctactaattttttgtatttttagtagagacggggtttcaccgtggtctcgatctcctgacctcgtgatccacccgcctcagcctcccaaagtgctgggattacaggcgtgagccactgcgcccggcccttttacatttatttttaaattaagagacagggtgtcactatgatgccgaggctggtctcgaactcctgagctgaagtgatcctcccacctcggcctcccaaaatgctgggattaccatgtccaactttccacttcttgtttgaccaaggatggatggcagacatcagaaggggcttggaaagggaggtgtcaaagaccttgcccagcatggagtctgggtcacagctgggggaggatctgggaactgtgcttgcctgaagcttacctgcttgtcatcaaatccaaggcaaggcgtgaatgtctatagagtgagagacttgtggagacagaagagcagagagggaggaagaatgaacactgggtctgtttggggctttcccagcttttgagtcagacaagatttatttatttatttaagatggagtctcattctgttgcccaggctggagtgcagtggtgccatcttggctcactacagcctccccacctcccaggttcaagtgcttctcctgcctcagcctcccgagtagttgggattacaggcgcccgccaccacacccagctaatttttgtattttcagtagagatggggtttcgccatgctggccaggctgttctcgaaaactcctgacctcagatgatccacccgcctcggcctcccacagtgctgggattacaggcgtgagccactgcgctggccaaatcagacaaggtttaaatcccagctctgcctgtactagctgaggaactctgcacacatttcataacctttctgggcctacgttctcacctttaacgtgaggataatatatctacttcatagacacctttttatgttgtctccaagttttctaacagctctagttctgtacccaagacatggcaggtggccaacgacatccttctaggctgtggtgatgtgtttggagcttgttccacgggtcttgtgtggggccagccctgttcagataaggccttgtggggtggcctggggtagggggaggggttgggcaaactctcccttaaaacgctttgtaaccatctgaggcaccagcaagagcggcccccgagcctggacaaaatccaaacggcttcctacttcaagcactgatgtctagtgagtgaaggaacagctctgggtccaggatattataggtcacattaaactaaaggggcttggccatcagctggcttccagagcgtcagccagttacttcacctctttggctttggcctgttttcagctacaagaggacttaatccagaggacctcagaggtccttcccagctcagaccttctttgactgtctcccagagacactgctgtaggagtgcacaccagtttacttttctttcttttgtttttgagatggagtttcgctctttttgcctaggctggagtgctgtggtgtgatctcagctcactgcaacctctggctcccaggttcaagtgattctcctgtctctgcctcccgagtagctgggattacagacacccaccactgcacccggctagtttttgtattttcagtagagatggggtttcgccatgctggccaggctgttctcgaaaactcctgacctcagatgatccatccgccttggcctcccaaagtgctgagattacagatgtgaggcaccacacccggccatttttgtatttttagtagagacggggttttgccatgttggccacgctggtctcaaactcctgacctcaagtgatctgcccaccttggcctcctgaagggctgggactacaggcgtgagtcaccgtgcccggccatttttgtatttttaggacagcgttttttcatgttggccaggctggtctcaaactcctgacctcaagtgatccacccaccccggcctcccaatatgctgggattccaggtgtgagttaccatgcccggctaccactttacttttcctgcaggctatcacagaacgtgtacaatctagactctaatcaaccaaatcaacgtcttgccatcggagtttgctggtgaagggcacttggggtcctggaaataactgtaggctccaagccacacacactgagataggcctattccctgaggcctcagagcccctgacagctaagctcccttgagtcgggcaattttcaacaacgtgctctggggacacagcatggcgccactgtctttctggtctcctggggctcagactatgtcatacacttctttccagggcagtgggtaacaaagtttgactccagaaagacttccctcgaggatttctacttggatgaagagaggaccgtgagggtccccatgatgtcggaccctaaggctgttttacgctatggcttggattcagatctcagctgcaaggtctgtggggataggggcagggtggggggtggatggagggagaggatagagaagcaaaacagggtagtgggaataaaatgacctttgagatccgacagctgtctacatgtcgcctgctgtgtgactttgagcaggttaataacatgtctgagctttcctcctcttaagatggggcaggggatcgttaccaacacttaccctcccagggtttgttgtaaggacgaataaggtaataggaaatgggccctcagcactgggcacccacatgtttgttctcttgagactcctatttctagaatttaaagccaaactttgaaaaataatgacaaactccaaatcgttggcatctttttttttttttgagacagtctcgctctgtcggccaggctggagtccagtggcacgatctcggctcaccacaacctccgcccccgctgggttaaagcgattctcttgcctcagcctcctgagtagctgggattacaggcgtgtgcctccatgcctggctaattttatacagacggggtttctccatgttggtcaggctggtctcaaactcccaaactcaggtgatccgcctgcctcggtctcccaaaacacaggggattccaggcatgagccaccacgcttggccaatcgttggcattctaaggctttcagtgtacctgacttcttttagttctaagtctgtaactgttaacctttcttgggccacggctatcacacggatctctctgggaatctgacgacagtgcctcaaacccgagggagcaccgccaggtgtgcacacacgtttctgtcaacgatttcggaggactcttgggatccctgaacaccatctgttccatgggaccttaggttaagagcctctgttcaaaggaggcttttgctcttggtgggtggatggggtgaagtctccaagccctcttrcggscccttcggtattcctatnccccggttctgccctgtcttagtccagtgctctctatttaacaaatgagcagtaaatgtacaccgatggactttgggagacaataaagacctgatattcaattctagctccttaaaccacaggagaacattctttcagcagacaacttcagttggtattaggccaaggtaagaaaggccaacagcatccttttctgaagaaacctcaggagatggctctctgccagaaagctataacctggaaggggaattgtaaaatagatgaggggctggatgaaggacgagaccagggccccgtcacgggagagggaaggcagctcctggctgtgtctgtcccccggcttttgggctctgaaggactaaccacatgctttctcacttgtctcagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgagtatgtctgaagaccctttcgctcttggtgggtggatggggtggggcagggtctttgggccttccactgtgctaagcagaacgcaagggctccacaggcttgtaggggggccgtggatgagtccttaatcctcatcgtgccagaagggaaggctgaactgccttctctcatcagactcattcctcagcctcacgagcagacctccctgacaggcgctcacaacactgcctctcaagacgagtctgtctgacctgttttctcatcttgacctaacttgctaaatgctcctgggcaagtcactccaccctcggtcagctcagacctcttcaggcctcagagaaagtcaacagtgctgcgccatcccagcttgcttgcaaagggatcccttggttggggtgttggggaaggcagggttttaacggaaatctctctccatctctacagagctgcaatccttgtttgattcaccagactttagcaagatcacaggcaaacccatcaagctgactcaaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaacttctgttacttcgttcctcctcctattttgagctatgcgaaatatcatatgaagagaaacagctcttgaggaatttggtggtcctctacttctagcctggttttatctaaacactgcaggaagtcaccgttcataagaactcttagttacctgtgttggataaggcacggacagcttctctgctctgggggtatttctgtactaggatcagtgatcctcccgggagggcg

SEQ ID NO: 3342 - DNA, 1069 bp, Homo sapiens
  Genbank Accession No. U30825
ggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaatcgttctgtctttgtggggttcgctctactatggagatcaacagttactgtgactgagtcggcccattctgtttagaaatatattttaaatgtttagtaattga

SEQ ID NO: 3343 - DNA, 2403 bp, Homo sapiens
  Genbank Accession No. U31342
gaattcctgggctcaggtgatcctccttccttagcctcctgagtaactgggactacaggcacataccaccatgcccagctaatctaggtctctgttttatttatttatttatttatttgtttatttttcaatacagagttttgctcttgttgcccaggctgtagtgcaatggtgcattctcagctcactgcaacctccacctcccaggttcaagcaattctcctgcctcagcctcctgagtagctgggattatatgcatgtaccaccatgccctgctcattttgtatttttagtagagacggggtttctccatgttggtcaggctcatctcaaactactgacctcaggtgagccacccacctcggcctccaaaagtgctgggattacaggtgtgagccatggtgcctggcctatttctatatatttttcaagatgcccagccaattttctgtagagacagggtcttgctccgttgcccaggctgaccttgaactctggcgtcaagtgatcctcccacttcgcctccaaagtcctgggatacagatgggagccatggtgccggcctgtctctggtcttatccactccacctccactgggctcttgccaccacaggcctggcctccagctccctacactcccatgcacaacctctcatcatggtggccgagtgacctgtgccctgatgcccctgtgcctgccatgcagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcttggaggccaagaagagagagctgctgctggtgacagcgggggaagctgcttccatccactgaatctctggctgcccgtgtccgtgtccccatgggtgtccagaagctgggaaggcctgtggccaccatgttaatcactgggggagcctcaagtattcaccgccatcttgagtaagggcagacgttttcccgtctctgacggctctgtggctgccatgtgagataagggcattaaggctgtaagtgaggagggaaaggcccaggagggggagaaaggcagactcagccagggatgggtgagggtttccctgtcccaaagcaagacccaagctgtgactggagggagaactggatccggatccatgaatattattaagcccgactgtcaatgaaagagagaaactgaggcccacggagaaggggttggccgtgaccacttagcaggctgctgtgaagtctccgtttggggactgaggcctgagcacttgcaatgccagcatcacaccctcttgtctgtgtgaccccccacctcccacaggctgtgctgcacatggagcagcagaagcagcagcagcagcagcagcaaggccacaaggccccggctgcccaccctgaggggcagctcaagttccacccagacacaggtgctggccctagtgcagggaggaggggctgcagggctggacccctgggtctgaggttggaggggctgggcctggactccagatctgagggaagagggactgggggccagattcccagatctgagggaagagggactgggggtccggactctgggtctgagggaggaggggctgggggctgggacccctgggtgtgagggaggaggggctgggacccctgggtgtgagtgaggaggggctgggggctggacccctgggtgtgagggaggaggggctgggggctggacccctgggtgtgagggaggaggggctgggcctctgggttcgttttgtaggaggggttcggatgtcctgtgccaccattccctccctccatttccagacgatgtacctgtcccagctccagccggtgaccagaaggaggtggacacttcagaaaagaaacttctcgagcggctccctgaggttgaggtgccccagcatctgtgatctcggaccccagccctcaggattcctgatgctccaaggcgactgatgggcgctggatgaagtggcacagtcagcttccctgggggccggtgtcatgttgggctcctggggcggggcacggcctggcatttcaccgattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatcccgctgctgctccgggccaagctt

SEQ ID NO: 3344 - DNA, 1362 bp, Homo sapiens
  Genbank Accession No. U31449
agcaactccaaggacacagttcacagaaatttggttctcagccccaaaatactgattgaattggagacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgt

SEQ ID NO: 3345 - DNA, 1739 bp, Homo sapiens
  Genbank Accession No. U31556
ggggcgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgcggggggcggcagcagcaggcacgagaagagcctggggctgctcactaccaagttcgtgtcgctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatatctggatttcaacttttcttctaattgtgaatccttctgttttttcttcttaaggaggaaagttaaaggacactacaggtcatcaaaaacaagttggccaaggactcattacttgtcttatattttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattcaaaaaaaaaaa

SEQ ID NO: 3346 - DNA, 5950 bp, Homo sapiens
  Genbank Accession No. U32576
gaattccaggggacatctgttgcgcacctactgtgctcacgctggggcctctgggatggacaggattctgccaaggcagacatctgggtcaagacagtcctgcacagttgttcaggttgtggccaaggttgcgtttgcagatttgccatgtaaaaatacaggatgctcagttacatttgaatttcagattaatagcaaaaaaaactttttggtataattctgaaatatttcatgggacatatttatactaaaacgtcatgcactgttgatttgaaattcaaatgtaattgggcctcctctatttcgtctggcaagcgtagacaaaagaatccagtccaggccaggcgcagtggctcaagcctgtaatcccagcactttgggaggccgaggcgggcggatcacgaggtcaggagatcgagaccatcctggctaacacggtgaaaccccgtctctactaaaaatacaaaaaattagctgggcgtggtggcgggtgcctgtagtcccagctactcgggaggctgaggcaggagaatggcgtgaacctgggaggcggagcttgcagtgagccgagatcgcgccacagcactccagcctgggcgacagagccagactctgtctcaaaaaaaaaaaaaagaatccagtccatagtcccctgagccatgtgccctggggtgcagctgggtccttcaggagaaaaatgctctatttctggcactgggaccgagcctgatgtgggttttttgttggtttttgttgttgttattgtttttgagacaaggtctcgctccaccacacccggctaatttttgtatttttagtagagacggggtttcactacgttggccaggctggtcttgaactcctgacctcaagtgagccgcctgcctcggcctcccaaagtgctgggattacaggtgggagccaccgccctggccctgggcctgatgttgatgacctcctactatgtgcacctgcagctctcctgcataggcctcagccgtcctgcatgaggacactgggaggcaggtgctccctatcaaccccgtgttacagttgaacaaactgagccccagaaaagaaaacgtatttgcccaggtcacacggtgaagaagtgagggattcgaagcccaggtccatctgaagccagagtcacccagaggagaaagagttggaattgagaactcaaggaatgcttggaagtgatcgggctcgagcccacctaggaagaaacagaggctggagacatgagactgtgttgctatttcctctcatcaacccttgggccctattgaggccctaccacaagcctggccctgcagcccagtgactaggagaaattagacacaagataataataacagcaatgatcttttttttttttctgagacggagtcttgctctttcgcccaggctggactgcagtggcgcgatctcggctcaatgcaagctccacctcccaggttcacgccattctcctgcctcagcctcccgagtagctaggactacaggcgcctgccaccacgcctggctaatttttcatatttttagtagagatggggtttcaccgtgttagccaagatggtctcaatctcctgacctcgtgatccgcctgcctcggcctcccaaagtgttggggttacaggcatgagccaccgcgcctggccaacagcaatgatctttgagcacctatattgccagtctccacggtaagagctttcttcattttttgttttgttttgtttcaagacagagtcttgctctgtcacccaggctggagtgcagtggtgtgatcgcggctcactgcagccttcacttcccgggttcaagccattctcctgcctcagcctcccaagtagctgggattacaggcacgcatcactacttctggctaatttttgtatttttagtagggacagggtttttcaccatgttggccaggttggtctcaaactcctggcctcatatgatctgcccacctcggcctcccaaagtgctgggattacaggcgtgagccactgcgcctttctttgtatttgttcaagtaatatactgaaatatgtactgtgcctcccactttatggaggaggaaactgaggccagcaaatgaggctgtcatgggaggtggagacaggatttgaacctgcctcagtgcaggaggctcaagagcctctgtcttctctcagggcactgtgtgggagggtgagaaggagggaggcccacagaggcatgacctctgattgccactgtcacctgggccctgctctctgaagtctctgccaagcggggaggtggccgggggagggccctgctctgtgcagcctcccctcccccggcccgcagagttgagcacagagggacagaggcacggaacccccagaaatgtccctcctcagaaacaggctccaggccctgcctgccctgtgcctctgcgtgctggtcctggcctgcattgggggtgagaagaagtgggtggagggatgtggggcccacacctggtgggtgtgagtgtggctgtgtgtcctgtggctctgtagccacgtgagacatgagtacggagtgtgtgcgtttcatggcgtgcgtatgcatgtgcgtgtcggggagtgtgtgtgtcggtggctgagagtgaagtgtgaatgtcacattggtacaaactgggatcatctgtgtgtgtgcacgtgcgtgcgtggaagtgggagtatgcagtcgtggtaaaaaagtgcatgtctgtgtgcatatgtgtatttgtgtgcacctgtctctctgtggggtatgtgtgtgcaaaatatttgagtgtgtggacatgtgtgagggggtgagtgtgtgctggtgtgtacgtctgtgttttgcatatgcattttttttttttttttttagacggagtctcactctgtcacccaggctggagtgcagtggtagcagtggtgcgatcttggctcactgcatcatccgcctacccgtttcaagggattctcctgcctcagtcttcagagtatttgggactacagacacacgccaccatgcctggctaattttttttttttgagacggagtctcgctctgttacccaggctggagtgcagtggcgtgatcttggctcactgcaagctccgcctcccgggttcacgccattctcctgcctcagcctcccgagtagctgggactacaggagcccaccaccacgcctggctaattttttgtatttttactagagacggggtttcgccgtgttagccaggatggtctccatatcctgacctcgtgatccgcctgcctcggccttccaaagtgctaggattataggcgtgagccactgcgcctggccaatgcctggctaatttttttatatttttggtagagacagggttttgccatgttgcccaggctggtcttgaaatcctgacctcaggtgatccgcccgccttggcctcccaaagtgctgggattacaggcatgagccaccacgcccggccatgtactttatgttaaaatgggatcatattctagatcagcattatccagtagaaatttaaatttttaatacagggccaggcacggtggctcatgcctgtaatcccagcactttcggaggccgaggcgggtggatcgcaaggtcaggagatttgagatcatcctggctaacagatgggtaaaaacccatctctactaaaaatacaaaaaattagccatgcatggtggcatgcgcctgtagtcccagctactcgggaggctgaggccggagaatcacttgaacccgggaggcagaggttgcagtgagccgagatcgcgccactgcattccaacctgggtgacagagcgagactccgtctgaaaaaaaaaaaaaatttaacacgtatgtagacaatgtgcaaggcaccattccatgtgcatcgtatgtagtaactcttaattctcacgataaccctgaggtagatattattaccccgttctacaaaaggagaaacagtcctggggagacaggataagtcaccggccaaggcacacagctagctacatgtggcccccgcgtgacggctggtctctgtaggcgaggctttgtccagatgcgtgggtagaaggtctggcccggaaagaggaactgacagcaaggctaagccaatgtctgcccctgggggcagaaagtcacctcctgctctccctccactgtccacagaggtagctcagacagggtgggggtcacaggagaacgaagggagaagggggtagttcctgggcagcaaaatcaggtggtgaagggaggcatcagaggatggcaattagagaggccattagaggggaaccacaggcagacagggtgacaggagggactactgacacaaggtgaagagatggcccagccggacggggtggctcacatctgtaatcccagcattttgggagcccgaggtgggtggatcacttgaggtcaggagttcgaggccccaacatggcaaaaccccatctcttctaaaaatacaaaaattagccgggcatgatggcagatgcctgtaatccctgctactcgggaggctgaggcaggaaaattgcctgaatccaggaggtggaggttgcaatgagacgagatcatgacactgcactccaccctgggcaacagagcaagagactgactctgtctcataaaaaaaaagaaaaaagaaaaaaaaaaagagatggctgatggttaaagaggggttagcggtcaggggacacataagggtaaaggcaggaggcaagaggactggcagggggctgcccctgggccaccgggagcgacacaggatgagcatggagggaaagggagaaggggattctagggtcccagcctacccaagttgccctctggttccacctagcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggtgagggtgtgctggcctgggtggtgggaggggactcctgggtctgagggaggaggggctggggcctggacccctgagtctcagggaggaggaaagggtgggagtggggctgtgacccctaggtctgggaggagtggagggttagagctgagagcaggaactcctaggtcacagagaggagcggataaatggggcagagaacacctggggagagctggggcctccactgtgatgtcctctctcctgtaggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaaaatgttcataaaagccaggtgtggttgtggcgggtgcctgtagtcccagctactcaggaggctgaggtaggatgatggcttgagcccaggagttcgagaccagcctgggcaacacagcgagatctcttgggggtaaaacaaaaagaaaaaaaaaagttcatacttctccaataaataaagtctcacctgtgtccctgtctggatccttccccagtgtggccagaaaaaaacccaccccactgcctcccaggaatcaatgagtagaagaggtgacacctgatggggaaggaagagtagggaggtcgggaagggtatcaaggaataacaccctattgtgggcttgcggagaatgggggacttcaaggcgtgtcagtttcaggagggtgagggcaggagcgtgggtggagtcagcaggtccccatgatggccctcactgagagcttcgcccttgtctcctacaagctctgactccattcccagtgggcacccagcacctccaacccctccacagcccccaacccagcctctgtcggaggcgaattc

SEQ ID NO: 3347 - DNA, 1712 bp, Homo sapiens
  Genbank Accession No. U32989
aaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaatcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttcaaaaaaaaaaaaaaaaaaaa

SEQ ID NO: 3348 - DNA, 3147 bp, Homo sapiens
  Genbank Accession No. U33286
gtcgcgccattttgccggggtttgaatgtgaggcggagcggcggcaggagcggatagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttgggaaggtaatatggaaacttggatgaataatttccatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctggaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaacttactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacatgttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttttccttttgaacttgtcacga

SEQ ID NO: 3349 - DNA, 2712 bp, Homo sapiens
  Genbank Accession No. U34252
ggatcctaggatgcttacatgcaatgatgaacccgaaaacacttgtaaagtgctacgtaaatattgatcacgaagaaggaagtcctcttcccgcctggagactgtgtggggtatggcggcgtggtggagagaatgtggtgtcttgttccaccctcctggagaggggagggcctggcctggaccgcagaggaatcgagtgactgcccctaaaatctcctagaaccgatcccgtggacccgtccctcccgagggtcccgcccctcccgtggtccgtcagcctctgccgcggagctgcgtccgccactcattttctccgagcaggcctggccgcgctctccccgcttcttcgcagtcttcggccctctcctgtcgccgccatgagcactggcaccttcgtcgtgtcgcagccgctcaattaccgcggcggggccgctggagccggcggacgctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtgaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaccttgttcctttataggttcctggtagaatcagtagagatgatttcagctcattgacatttttaagctgtatccccttgtcattccattgagaaagctgacaactgggatagggaggggattagataatagatggggtcaaattctgtgtgaatgtgaacttgcctagtaagcactttgtctctgttcactactgcgatagaggaaatctactccctatcttgggtccttgaactacagcctgctgtcttacaccagtggagctaccctttaaatgtacaaattaatttgtatgctaatgtaatatggtgaaattaaaataaatcacactgttaattgttaaaaaaaaaaaaaaaaaggaattc

SEQ ID NO: 3350 - DNA, 33023 bp, Homo sapiens
  Genbank Accession No. U36341
cttgcctcagcctccccatagctgggagcacaggtgcgtgtcaccgccccagctaatttttaaattttttgtagagacaaggtttcgctatgttgcccaggctggtctcgaacccctgggatcaagtgatctgtgtcaggcctctgagcccaagctaagccatcatatcccctgtgacctgcacatatacatccagatggcctgaagcaactgaagatccacaaaagaagtgaaaatagccttaactgatgacattccaccattgtgatttgtttctgccccaccctaactgatgtactttgtaatctcccccacccttaagaaagttctttgtaatctccctcacccttgagaaggttctttgtaatttgtaattctccccacccttgagaatgtactttgtgagatccacctcctgcccacaaaacattgctcctaactccagcgcctatcccaaaacctataagaactaatgataatcccatcaccctttgctgactctcttttcggactcagcctgcctgcacccaggtaaaataaacagccttgttgctcacacagagcctgtttggtagtctcttcacatggacgtgtgagacaatctgcccacctggtcctcccaaagtgctgggattacaggtgtgagtcaccaggcccagccgagaaagagttgaatacacgtagaggagactggagttttattattactcaaatcagctgccctgaaaatttgaaggctgggatttatttatttattttttatttttttgagatggagtctcgctctgtcgcccaggctggagtgcagtggcatgagctaggctcactgcaagctccgcctcccaggttcaagcgattctcctgcctcagcctcctgagtagctgggattacaggcccgtgccaccacacctggttaattttttgtatttttagtagagacggggcttcaccatgttagcctggatggtcttgatctcctgacctcgtgatccacccatgttggcctcccaaagtgttgagattacaggcatgagccaccgtgcccagccctgaaggctaggttttttttttgagacagagtctcactctgttgcccaggctggagtgcagtggcacaatcttggctcactgcaacctccacctcccgggttcaagcgatttccggctaacttttgtatttttagtagagacaggggtttcaccatgttggccaggctgctcttgaactcctgacctcaagtgacccacccgcctgggcctcccaaagtgctaggattacaggtgtgagccaccgcacccagcccgaaagctaggattttttaaagatagtttggcggacagggggctagggaatgggtgctgctgactggttgggtgggggatgattcttgtgtgctgagctgagtctgcttttaggtagggccacaggaccttgagtcataggtctatgtggtccgggtggagccatctggtagtgagaaatgcaaaaacctgcaaagacgtctcaaaaagccaaccttaggttctacaatagtgacattatctacaggagtaattggagaagttacaaatctcttgagctctgaacaatggctggtcatcatgaatgcttccatgttagcagaattcaggcccctctcatcctcctcacctgatggcctttcattacttttacaaaggcggtttcatcttgggaaggtctgttatcatttaaactataaacgaaatttctcccaaagttagcttggcccatgcccaggaaagaccaaaaacagtttggagggtaaatgcagacagggttggttagatcagctctctcactggcagaattttgttactgttacagtttttgcaaggcagctttagggtgatgggtctgcacggaatatatgcatgtaacagaaccgcgcttgtaccctctcaatctataaaacaaataaaaccagcctaataaaagtttacataaaatgtaaaaaacaaagcaaagcctcctttctgcgggtctgtgtaaacgagcacagctggtgggaagggcgcgggtggggggttctgctgccccccatccctgccctgctgcaggccctcgcccccagccccattctttctgttctccgcttggctgcagccgcacgtcggccccctccccaggagctggaagtacaaagcccttccaggtggactctggctccccctttgttcccagcttattctaattccaaagctcattgtgcccggctcgccttcagaagaggaggcgcccccatcctgtctccagctgcccatcctcccaggataaccagtcaccccagggcccggtggcccctcacccagcccctccccggtccgcagctgccctaggcttgagtgggcgctggctccaattctcaggcctcccccaacaaacaggagcattccggctagcccccctcccctgccctccccccagctccccttctcctcccctctccctcctcctcagctcctactccaaccccccagccccagctggggcctgaaaggctgcccactccctgggacacggtaaggggagggtgcagctctccccccgcccctccccggtcgcctctgccccagagaacagtttgcttctcacccagaagccaccataggagctctgggctgggcacaggtcgcagggcacccccaccccctcctgcacatgctcggaaccccccttcagtgagtagaacacaagggcctggcaagacaggcggaggcttggaaagggctggcgggggacagctacccggccctcagctgggggcctggagagcccaccctgcccctccccagcagctgctgcccccgggccgagcctgacgcgccttgacaaagcccgagaacgctttgaagccttcggacgtgggagaggacccagccagggatggaaatcgctttgcctttgttcccccaactgctcagcagctcgtgggagcagcctcagaagaccctgtcactggccgcccgggtcagagcctgtgacagagaccagagctccggccggagctccccgccggaaactccagccttaccagcctgaacttcatgcactgctcaaagaggcccagctcgccctggctgggcaggggcggctcccagggtggccgacgtggggagggttcctgaacctccctcaggagcctcctgggacagagtcctggaggtcagcagagaaagggaagcccaggctgtgggccccgcgtggagggaaaactcagggggaacgccccgaggctgggagggcacagccccatcacactccatctcgtagtcttggagaaaaatttagttctacctccagggcacagaaaagcccaaagaagggatgagataaaggaggggctggtcagatttgtgcttcaggagggtccctctggctgctcagagaatgcagtttggggtctggcccaggccgtgaggaggagttcacagtcactatggggtccagaccagctgggggcgggaggcagggcctggcccaggggctggtagtgggtgcaccccaggctgggctggcaaagggcggggaagaaggtgggtgtgggaaggggtggctgcctggagaagagcccagttccaggaggtcgtgggagtcaggtatgggggcccactggacctcccctcagatgtgggggctcccactccgagggtccatggagcagtggcagccattctggacagccccccacccttcacttctgtctccagtaccctccagcctggccacctcgccctctgcctcggcctcctctgatctcacaaaggcagcagcagtcaggggtggcgactccctcatgatcctgtccctggcctcggaacccaccggaggagtaaccgcagcagtggtcacttccccaaagtgccatcagctctcctacatccttctcgagcctctgctttctctcccttccacccccacccctttgacaagcaacatctgaaagtctcccctgcccgcggctcccagagctgtctggccgtggcctgcactctccctcaaagcggccctcccccaggtcaccgtcctcccttcgatgacatcacgcgcccaccccgcactcctgctgggctgaggccctccgagcctacttcaccgggtcctcttctttctctcaaaggcaatggggtttgcctgtggtccagctgggttggccctcttccctctgtcctgggtccttgagtggccccgcttctttaggccatctatgagtcacttctctaatgcccctgtctccagaccagcttcagtcaaaggctgggccagagaagaccctagtgagaaacttctgatgagcagtgtgaccttgccacctcaggggtacccacccaccacccctggtctaagcacaggtgacaccgcctgtctcccccaaccacacacaccccttgaggctcctcctccaagcctgggtggggacactgtccctccctcacccagcaagctcaatctggcttgggccggaactgcttttcttcctaaagctggacggatggccgcgggcttagcttaacgggatgagccatctggggactgcagtgtccacgatcagatcagggagcttgaagctgaggggggcacactttacctcccaggccaggacaatgaccacttccttccccaccccacccccaggctactcttagccctagaaaattctaaacaagctgctcagctggcggcggagaggcagcccaacaagctggctcttgctagggaggcctggggggtcctggggagaggaacacggggtgggtggggggcgggcagccaggacctcaggcctgaggcctttggggaagggtctgtgcacctgccaggcaccagggggcagccttgccttgttcccgctccagtcccctcaagtccgaagcccctacccactctcacgccaggcaggggtgggggccgccggggtcatttacccgggccccttctctgccttgatgacaaagtcgagccttgctcatcagccaggcaggctcccctctgcccactgtggagacacagaggcctgtcacctgaagagctggtcccggcctccagcttccagggtagccgggaagctgtagcccccagtgggcagcggtggagagagctcaaggaaggagggagcaccgggaggagacggctgcagcctgccaggagcggggagaaagggagagaaggggaggcggagggctgagggggcccgggggacgtcttcccagggctgggaggggccggccgggaagcctgggctgcactaggagccggcgaccctggggcgaggggcggcccggagccctgcgggaggagctggcggccgccccaggtagcaaccatcctgcctcccgctggagcggcgtctcctccccgggaggagggcagggaggaggtgggcggagtgtgacgaggagggcgggagggagggatgcgggagggggagggggaggggggccggccggccgtgggggtggggcgatagtgacatcaccccggagtcggtttttaagcggcggccggccggggacggggaagagagggatagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgtcgtttgcagaccgcgggcgccgatgtcgcccgcgccccgttaggatgagtctcgggtcgggcgaggagccgccgcagccgccgccgcccgagccgcgggcaggagcctcgggagccgccgccgccgccgccgccgcccggccgggccccgacgccgcccgcgcgcccccgggcccccgacacacatgagattcttcaggctcactttcaagtgcttcgtggactgcttctgactgcgccgcccgcgccccgcaccccgccgtccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccggggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgagttcccccgcccgccgcggcctcctcccccagcaggccgccggcccccgcccgacccccggagccgccgcggaggggtgaagtccgggcaacgggtggcccccgggcacgcgggggtcggggccgcccctcgtccgccgctgccgctcggtggccgggccgggcgcctccacccccctcgcagtcatgtgcctggcatggtggggggagggggccggcgatgcccgcgaggctgccccccagactcccgggctgggaggagcgattggccgccgaggtgggaaagcaggcctgcgccttggggtctccgcgaggtaaggagccctggctgcccccacgggtcgggcacacaagcggcacattgtgtgggccccccacgtgtgcacacacacgaacacacacacacacaatgggccactctgtccctccccctgccctcccctcccctcgcggccctcccgcccctcccctctggcccgggcctggaacactgggtgcccgagccaggcttgggaagcctgcggcctggcccgcctggcgccgccactggacacactgcatgcacgtcccatgcccgcccgcccgcccgcccgcccgggcccagcttagcaacagcgatgggcacgcgtgtgtcctgtgactacaaaacagcactggggttgctggaagccgaagtgacccggtgatgggtgggaaacagaggtccagagcaaaggcctttgcccaaggtcaggagaaggatgctgggacctggagtcaggcaagttgcagccaagctcagcctctgagtagtggagcgagcccagccagggcaagggtaggaggcccagagaggagaagggggtagtggcacccagctctccctgcccttctgccacccccaccccagcctgctggcctcaggagataggcctgtgtcacgccctgcctatctcctgcagagcctgactccctggccttgctaaggccggcctggcccctcttccgcacctgtatccctctgtccttgcacatcgccatcccaccagcaggggactgtgacccacccaccctctgccttagacctcacacttgcaggcaagcgtccaagggcaggacagtcgcgctccctgcctttggatgagccccccaggcctgatcacccagccttggcacacatgcacacatgcacgtgccctcactgtgctgcctgaaacagggaattgcagcactagggacagcccgcgtgtctgagcgtgtgtgtcctccatggccatcgccccaagtgaccgtgggggtggaagccctgggggcctagggcccctctgccacccagggaatagggctccaatggctcaggggctactgtagcccctcttcaacacactcaacccaccccctcaagactccacctggggcctgagtcagtggccacccctacactgactcacccagtcggaagttgtgatggggcctttggagtctgggctggcccgctgggcctgggcagcctggctgggggccaccctgagtccacgctgtgcctccacccccaggtgtgttccttattccctacgtcctgatcgccctggttggaggaatccccattttcttcttagagatctcgctgggccagttcatgaaggccggcagcatcaatgtctggaacatctgtcccctgttcaaaggtgagcagcccttggccagcctcagggactgcccccttctcccagctggctcccacttgagaaatcttttcctgtcgtgagcaccaggcctggggccacgtgatggcgtcccagtctcgaggggggagcctggaggagatgttcaggccgcacagcgaacttggggaagcggggactagagggggcataggcagctccacaaggcaaggacaggccaggcatagccgggctggggacgggacctgcccagcagcacccttggctctctaggtaggtcctactgttactatccccaaggacgctggggcacagacaggtggagcgacgtactgaggttgcccactgcaggggcgactgtctccaacactacctcaggcgactagaaacccccccccccccaccaccaccatcaacaccagctgctgaggactggaggctactgggtggccaggcagaggcttggacctcctggaaccgccatggtggcagtgggacccacagaaggggccaggtgtatgaggctggagactccacagcacttggtcagatggggacaggaggagaggggctcgctctgccttgggtctagggggcggctggaggagaggagacaggctggggagtcagcgcagtgttggggctcacacaagggggagcccaggggagtcaggagcaccacaaacaaggctccaggaggacagatggtgggagcacggccagcctgggtggggacataaaggggtggcagggggaggtggccagggaagaatctacatggcaaggacttcccggccccaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagtgagtccggcacctctgggccaagcccatcccatcccccaggtctccctcatgttgcccggctccaggggagtggccctgagggggcaccagggtgttgcctggcagtccatcctggaccctgcctgcccttgcctgtcctcggagagtcctggggccagcctcgctcctgggttcggcagccgatcactgtcctggtcactcccccctgatgggggagctggggctgcatgtgaggtgggatgggagtggcctcccaatggccaggggatcgtgggctccaggcccagcccaattggacaagagggacccgctgaaccctgggctgtgggagagaagggagccacaactcctgggggtggaccctgtggctccatcctctgctggcacaggcctcatgggacctccctccctcccctaggaacaaagtcttgaggctgtctgggggactggaggtgccaggggccctcaactgggaggtgaccctttgtctgctggcctgctgggtgctggtctacttctgtgtctggaagggggtcaaatccacgggaaaggtaccactagaggcatgcagcggggagggtggctcagccctgggagccggatgtctgtgccaggcacacctgtggcaacgggaggtgaccagacagagtctagccctaaggaagggggaggtactgaaagccaagcaatgctccccaccctgcaaatccagggcccagcagcctttgctcctggggatagaggccctggcaggcactgtcccttccctgtgcccatcacccccactggtgccctcctgccagtctctgactcttgtgacagtctggtggacctggtctggccatctgttacctatcttgccttggggacccagagcagagtctggccacatcccttgggggctcctggtcaggctggggagtcacctgaacaaagaagacagtgtctagagctgtgggacatggccagctccctgggggacaaggtccccagagcagcatgtgggaagagggggcagacagtgtggcagctgcatctcgcctgcctctgcctggcccagttccactctccacctgctcaacccccacctctctccagaagaggagggggacccgacccggatccaatatcccgctccctgcctgggcctcccacacctgcactgcccacacactcatacagctctcactccccacgtgctccacgcctcctgtccccactgaggagagctcccagaggctcgcctgctccccaccgacacgcgtccctgcagacaaacgaggcgcccagggagcttccccactgcacttggccagggctgccggggcgcagccttgcccctagcttcctctggcgggagccatggctcggaggacaatggggacctctgaacatacctgcccgcaagggggaccggaggcgctgggagtgggggtgtgagggaggtggtgccacagcctccgctgagcagcctggccccccagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgaggtggaggtggagaggctgcagcagggcgctgcgggggagccctgcaggcccctcatgcctgcgctctccggcccttctctaggtgtggatagatgcggggacccagattttcttttcttacgccattggcctgggggccctcacagccctgggcagctacaaccgcttcaacaacaactgctacaagtaagcaccgccgccctgccacccgtgccctgtcctgccctgccccgccctgcccagcagcctaacccatccactctggcccctccacccctcagggacgccatcatcctggctctcatcaacagtgggaccagcttctttgctggcttcgtggtcttctccatcctgggcttcatggctgcagagcagggcgtgcacatctccaaggtggcagagtcaggtagggccctacccccagccccgcctccagagcagcgagtgctacccagatgcatgatgtacaggaacatgcaatagaaatgctgaaaagtgacgaggattcaaacggaacttgtcagattgtgggcctgtgggggcaggtcctgggatttgtcaatgttgacagagaaaggacctcccagcccctgccgcacgacccagggttgacagcgcctctgaggcaggcgtgggcatgggcgcgagtgttgcaggcagggctcagggtgcgcacagggcaggacatcggctacaaggtctagagcctgcacctttcccacagggccgggcctggccttcatcgcctacccgcgggctgtcacgctgatgccagtggccccactctgggctgccctgttcttcttcatgctgttgctgcttggtctcgacagccaggtttgcatggggctctgggacagggagccaggaggggggcggagggagggctgcaggcaaggaaaggggtggagggcggtgcggggctcggcctgagctgccctggccacagtttgtaggtgtggagggcttcatcaccggcctcctcgacctcctcccggcctcctactacttccgtttccaaagggagatctctgtggccctctgttgtgccctctgctttgtcatcgatctctccatggtgactgatgtgagtggggtggggggtctgcctgtgacctctggtggccgtctgccatcctccctgactgggctctgtcccccagggcgggatgtacgtcttccagctgtttgactactactcggccagcggcaccaccctgctctggcaggccttttgggagtgcgtggtggtggcctgggtgtacggtaggtcatggctgagggctgggctgggggatggtggcggggaaggcaggtctccagcttggccctcccgcctcacctcgccgcaggagctgaccgcttcatggacgacattgcctgtatgatcgggtaccgaccttgcccctggatgaaatggtgctggtccttcttcaccccgctggtctgcatggtaagggctgggggaggtggggcagggcggggggcgaggcagggcggggtaggggccccattaaccgcagcattctggtccgtagggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgaggtaaggctcccgcccggcccgccctcccctcccctgctgtgaacattcaacccagcctgcttcctagccagggagtggccccgactagggtggcaggcagtgggaaccggagagaggcagaggaagtcaccgtggggacgagcaggtgaccctgggggcttcagcatgtcctcctctcctgcagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaaagcaggctcctgcttccgcctctgctgctctaaggaaggggtcggggtacaggaggcagggggaacctcctccagctggagctgctgccgtgagcaaggctctgctctggaggcctctgcggccggcacccttctggggactgggaagggggcagggaaggcagcagcccaggggaaggccttgtccccctggagccgaggcagttggggagagcaggacgagagtgagctggagagcagccacacccgcggggaagggtgggcgtaaagccatgggtgctgaaattttcaaaatgttaccccaagaatttgtcactgaacaggtgccttgtgtcacttgggccaggctggtagcagcagaggggataactctgcatcagggatcaattttgaaggtggagccaataggggttgtgcatgaccaggatgcagggctcaaagaggagttaaggacaacagatttggcctgagcaagaggaaagatggagctgccaggtcctgcaatggggaggcaaggagagaatggtctggagtcagccttgggtgtgtcatgcaggaagtgtcatccaagtggagatgtctagttggcaggtggacacaggagttccagaaagtactggagatggaactgtgcaagttcttaccacatagagatgacactgaaagccctgagcctgagtgagctcacagggacgccgcaagccccggaacacaatgagaggggcagagcgaagacgtggcagtgataggggaggacgcctgagagttcctggtggggtcctgcaacctgagccagtgaggacccctcacaggtcagggaggagcagtggctggctccatctgtccagtgctgctgctggtgaaggacagtgacctgcaaatgctcactgagtctggcaagggtcacgggggcctggcgagggtggcttgcatgagcgggtgcgtgtgaaaggctgggtggtgtgcgactgagaaaaggagtggcggcagcgcagtgtcatctgcagacgaagggagagacaacaacgtagttcacccagacaaggaaatatgagccagcctggaaagggaaggcattccaacacacgacacaacatggctgaccctggagggcatttctgtgaaatgagccatcataaagggatacttgctatagggttctgctcctgtgagagagacagggccttacatgagaggagggagatccacagagacagagggcaagggtgggtgccaggggctggggacagggtggggagtgttgagtggggacagagtgtcagtttgagaaaataaattctagaggtggatggaagtggtggctgcgcaacactgtgactgcacttaatgccactgaattgcacatttaacgatggtgaaaatggctcattacatatacactgatgacactatatatatgtatgatatatatgcgttttaccatgagaagaggtggagaggaattggagacactgagtacagacaggtccttcaacgggcgggaccccgtgcacaagatgagcatgtggcaccccaccctcaaagggctgggcaccatggcagggcacagcaggcaatgcagtgggcggctcaggcaagcacagagagcatcagagattggagcctgtgaagggggagcaggtgacccctcagagcaaagtgacagcttgggctgctccctttgcgtcctgcccaggactgctatcgtgctatgggagaacccccagaggccctgctcctcagcaggcagcaccccctatggaggggctttacccctaaacttctggagccaggggagggacctggcttggaatacggccaaccaagagcctgggtgagaaatacacggaccagacagggagcagagaaaggagtggcagtgcagtcccaccctagctcagccaggggctctggagcctgtcctgcagtccctggcccccatctcttcagcaaccgctgtttccagttttctttttctccctgagaagcctgtcctctcaccatgcctgcgccttcaagaaccccgcctgctggcagctcccacatctccggcctggccctccttagctgcaaaggtgcttcccaacatcagcaagacctctccccagggtgccccaggccctcacacagcccctgtccccaaccgactccaactgtcctgcagcccacagtcaccctcaggacccctgagctcaggccaactgctttatacactgtcagccaagtctctgcctggatgacaatcaccctctgctaattgttctccgcacctccaggccaaatgccctccaagccacctcatgcaccacgatgacactaaacacacagaaaaaagacattgaaaaaaggaaacttcacagaggcctgtcacttaaagagggtcctgaaatagagacaccatttcctcaggacttagctcctgcatcaggggttaggacacagagatcaacaagcagcaggctttgccctcaagcagctcgcagtctagtggaagatgggtaagaaaacagatcaggacgcccacgggtgcagatgccctggaacagaagctgatccaggaaggcgcgagctgcaggccgccctccagtctaggctgggcaagcacctcaattttcatctctaagagcctgtgcccacaccccctgccccgttgttgttccatcactccactagaaagggcgctccagaagctggcctcgtgcagctttctgtctgctgctggcctaggcagaacagcggaagaagccatcagggctggtgagggaagcacccgtttggactttagcctttcaaagctcagagaagggtgagctcagggaggtccaaggtagctgagagcacttcctggaaaagtgggatcagccttcggccttggcacagcaaccagagggtatcgcccacgtgtcccctactccctcagacaccacctctcagaccgcctggaaagggacagaactcgtcatgaggcggctgtgctctgagcacaagggaagggcgacaggatgctagagaagggaaccactggcctgggcccggacagggcaggcagaagcgagcatgcacagcaggccgtcagctaccctgccagcatcaacatccttcaggggtccccccagttccaggagacacacctctaacctgctcccctgacccttccgcccagtcctcatgcagacaccaggcatggcagaggccctgcagggtggaagcactgtgctgcgggcgggggctgccttcctcatgtgctactggagagtagcacagtgcaggggcctgggcactggtgccaggcaggaagccccggtactggcctggcttgctgtgggcctggaagacacagctctgagggagccacgggagggacaccctggagccagcacagcgctctggtggcaggcacacacccagcacgttctcagggccaagggccccagcccattcccagcccctttctgcctagctctgccctgggccagctccaggtcactgccaaggacaagtctcctctcccagctggcattagtcagaggtcatcctgcaaaccttcgggggggggggcagggagtgactagtggcgttctgccacgttctgtctgtcccaaatgtgacgaacaggaacccagagaaggcaagcgagtcctctacccggaagccccgccggtttactgagcctcccaagctgcccacacccagggaggcagacaggacacacactcggcgggtggccctgaagcgaggcctggcccagcccggggagcaggaggacagagagggcaaggccttcgagaacaggtgtgagcctggccttcagtgggggaaacaggttgaagggctgtggccgcttgggggctccaggcaggagagaaagcagagccctccccacagctgcagtcacacaccgcaccacgtacacaccatgacaacttttattgccctcaagagaaactccagtccacctgctccacccaccctcctgcgggaccaaagaaaacacccagagggcaaaacaaaaaggggctcaaaccaacaggaagtcagccccaccgcaagccggactacaactaactcgtgctctccacgctcaggcgtggaagccaaggctgtgccaggcctggccaggccaagcaggatgacagcaaacgcattctgaacgtgtagcaatcaggtcccctgtaatgtgcttggagagtgtggacaagggccgagatgacgagctatgagctgtggaagggaatgggggaagcagaagggcacaaacagaagtactggagggagaggccaggctctcaggaagcagcaggcacgtgccaggtggaagccagctgcaggcaggggaggaaggaggcccttactcttccttcttgtccatgggaccatctactgcagcctggaaagggacagaaatcccacagcagtaggttggccgggtccactcctcccctgccacctccagccccatgccccagaggtccacctcggttcccctctctcctaacaacagctattcaagtgaacaaggggccccctccccagctgcacccaaaggcctgccagggtgggagcgtcagccctggcccacgctctagggaaagccctggacctaacgccagccagggaggactgccaggacctcactgggggctgagtcctggctgcagggaacagcaaggcatccagtccccttcaagacctgatcagacccttcccaactctgcacacctttgaacaggtgccctcgaagcccatctgccaagcctgccccatacagagggcatgggtgccccctttgaggctggacccttcctccccacctgctgtggtgcccaaacttgggccaccaagcactgaggccagctgtccaaagttaggagtatttatgtggccctcactcccaacgtcaagaccgcctgggcttccagatgcggcctggtgcacccaagctagtctgaggactcagatcaggcctagggcagcaggtgatggccacaactagcgcctgctagggaaggtgcctttttgacaccttgtgccctcacttgcccagggatctttgccctacgtcactccccagcaccctaggaaagaaggccagcagtgggtcccagagtttcacctgcttctttgttcttgaccaggccccaaaccatggctgcgcctgagcacgaaggtaggaaggctcagagcctagtgagccagtgccactcctgagggccgccttggcaagtgcctacatctgctgccaggccacccccctcctgcccggtgaagggtcccactcagtagggcagaggtggccagggggagtggtggagagggcagccagcccctgggcccctggaaggttccctccgcacccgcaggggctgcctcatcctgctctgctctcctgccctgggcgcagcaatacgggagggctgacctgcagctttgcgtgctcctccagcaagcggtcgtactccttggtgaggccctcagactgcttccgcatggccagaacctggttttcagctttctctagttcttgaaatgatgtaaatgaccaagaaaacagaaacgaaaagacaggaattagggggaaaaaacccgactgctacagacaccagaaactggcccaaatctatctcaaacgaggttatacaggaggctacttctcaaaataaagcccctctgcttttgcaggcccccaaagtagagggaaagggctgacaaaaaagctcaagataaagcaaaagaaacacagaggccatcccccagtccctttaatggagaggaactctagtggctctcggcaagggtaacctccagggaggctgagagtgggagacagggagcaagatcccagcctgcaagcgagacccaatgacaaccacgccttgcacacagcagcagcaggcgaggcctgtggtattgggggaaaacgccccagacttaagtctatgcgtgggagaccaaagacaggcaggccgcttgggagccgcccactcccctcctgaacgccactcccacactcccctcattctcagcccccaggcatgctggggctaccgtgccacactctggacgggaaagccccagcatgcactgctctagtgcagggcaatcgaggcccaccaactgcagcctggttcctcctgagccccattcaaaccacttagcctcactggcctgccggctaagcatggctgcattggggttggaggcgcagggtgctattggtctgttttcagccagccctcgagcgtgcgtgcaaggcttgttactaatactttggcacaaaatgggcagcagcgggcagaggaggctcctctggacttccctgcggggaaggacacgaggtcgagcctcactttgcttagtgctggccagctcgtcctttagcttctgcaggtcagccttcaggctcctgttctcttcctccaacttcacctcagcattcccgacatccaacttgcctccgtcaacagcagctccctgggaaaagtgccaaaggccagggttactcaggagggagggagggagaggttccagccccatcctccccaccgagctgcggttcctcaagctgccctggccacacgccccttcggaaatgtcaacgcggaaccgagccaccacttgctcccagctcctaggcaaaggccagggcgtggctgcccgccgagggaaagagaagcgccagcggggccacctgctgcagctcgccgggcacgccttgcctgccctggcccctggcccctggcccctggccctgcctccttcccaagcagcagggctcagcagctccatggtgctcaccaacccctccacagatggcggtgcctcgtgctccctacatggtgccgctcactgcagttaggagcccccagtcggcctggccagctctatcccacctctgcatccacatccctccgagcttgccttgcagctcacctcctgacgggacgtctaagactggccaactaccctgcccccacctcctctccagcactgagggatgccacagaccccgagttccagagggggtgcggcaatcttgcagggaacaagggcctagctgagggccttcggatcacagcagagggcctggctcactgaggggccatttttctcagggaagggtctaactggaagcagtggatggaaacgagagcagcaacaccctcctcctcacccggaccctcacacacagacgcctccagcaggcatactctccccactgaggacttcccctctgcgcctccacccaactctggcttttcaggcacatttcccagcgtgacaggctagcagtggccactgaggccctgaagaatgtggctcccacagtgtaacaccaggacgccccatggtgggtcgggaagctgggctcaccttcttgagctggtcattctcctccatgtacttcttggccgcctcactagcactctccgcctgctttttaaaggcttcattggaggccagcagcgtggcctgctgcgaaatgagagtcaccaggcgtctaagcaggctgcaattatttacaaaaagaagggagaagtgagaaaaagagcatgaagggctggcaggagcacctcctggttgctcccactccacacctagctccagcctggacctgccctcttgccaaggcagccgagtgagaagccgccaacctggtgctggcagcgtgagggaaaaggtggggcccaggagccgtcctctgccgctgtgcccaacggccaccctcagctctcagaggggctggaagcaggagcctggggggctgggaagagcctcgctacagcatgaggtcccagaacgcggcactttccgggtcggggcctagacgtgccagacaagccacagcaccaccttcctccctgcgaggctgggcttgccttggtaaggtaacgagagaagctaatcaatccaagcacttccaacatgccaggccgcatcctcacatctacctgatgaggaagttactatcactgccccagcttatagaagaggaaactgaagttcagcagcgtaaatcaatgtacccaaggccaaaaaccagaaatggacatggctggaattccaaattatgtctgcctgactccagaacctgagctcggaaccactctgctctctaaactaacagggaacagctcccaggtcccaacgtaagatagaactctcttctctggccagcctccttcccaacccatcatgcaggctgcgctggaacacatccgttatgtaacagcaccccgaatgaggtcttcttgggctggagggtgtagaggaatcaggacacaggcgcaggctgcctctctgaagcagccaggagagacaggcaaacaggtggcagctggaggcagatgctagtccccaaacagagattggaatggccacttcatttcccttggttcacccttgccccgagatgttagctggcaggaagagaggagggaaggactcgttcaaacagtcaaaacaaggcaggggttcctttctcacacacctcagaaggcaagggtcacacagggcctgggggaaggaagagacaaatctgcttagtccagagtgcttcaacaacagcttactcagaagagtcgaagtggcctcctgccccagccaggccttcacacttcacagcctctgctcatggccaggggcagcccggaagggctggagaaagtaaagagcagacaaggtgagctacctccctggcccaagccatggctctccagggcctcggcagagcccctttccagatgtactcaggacagaaagtacccacccgggccaggagacacccctgaggttcctggtttggggagaggctcccaggggcccctggcagcaccaggagagccaggccgttgattcctggcagagaaggagagtttccagtgacatgtgctttctaaaattagcggcccaggacctcgtggcctagggctcaggtttccctgcctcagcccccagctgcccaccagcctgccccgcactgggctacagcctgaaggtggaggaagctactgagcgccctaggagccagagagaaacaatgcatctgactcacatcggcatggccagaagtcaatggagaggcctagaaagaaaggcaagtctgactaagacccaggcccccggcaaggagctgcccagccccagagcggatcccagtgatgtagaaagaggaagaggaccgctcctcccagctggaattgaggggtgggggtcatgccacctggtggtagagagaggaccaagcaagactgaaggctatactccccgccaccaggccaggcaagcggctgctggtgagtgcccatggctgtcaccccagtacccagggagatagctaacacaaatgcttccgcggcagtgcagcagaggcccagctcttttcggaccgtcccaggcccttcccggctattgagaaccagggcttccaagataggccagggcatacacaaagtccagcgcaagatccacgctgtgtgtgtccgaaagcctggccctgctcagccccagcccaggccttcagttcccagccttgagacagtctggggctcccctctgccaggccccggttccccttcctcttgccaaccctcacaggcgctccccacccccacagcaccccgggcatactcctcccactgcacccccagcccgatagttctttttcacaccttctaggtcctctctcttcctgctggatgacccgggatcattctccccccaggaacctcaccttcaactgcctccttcctggagtcaccctgcccaagcccctggtcttttccctcccatatattcctcaacctaggctggccaaggcctgcccttccaagccagcagcagggccaccagtggcctcctaaccgcccaggccggaggtcaccctgaactccttgctctgctgctaagttaccctcctgaggtcccctcgcaacaccctcctcccactgttattctgctccctctggggtctgcactcttcagctgacaccctataccttcctcccagccactcttatccccgaaagggttttctctgtggcccagactcatacctaacctcctgctaaacattggctcctggatgtccccagagacattctagactcagcttgtccaaaacgggccttcccttgtcctgcctgacctgaccacctcgtgtagcccctgctgtagtggtgggcaggcaaaccgccttggactcagccctcttggcccccagcccaagccacaacccagcactttccatgtcaactgcaaacatgcccaccatcatccccactgctggcgcctcctccctatctgctgccatacggctttcccatccacctcccagagcaaggcaaatccgaccatgtcagccctctgcttaagccacctgctgccagcacgcatgccctcagtgagctctcctccttcactaaccacgtggccccctgctctagtaacacctaacccctcaccattcctggaacacgcctggctctgtgtggcagttctccaggccggaatgtcctctcgacccagctcaatcctcacctccccccagaaacccttttggatctcccaccccatcagagggacgccttctgggggctcctgcagcagccccccaggcacccgcatgtaactacctcattctctgttctctgcgtggctgccatccgtttatatggctgccctaccaggctatgaaggtctttaggctgggcactgtgccttcatctctgcactcccatacctggcacactgaaaaggggtcttccgcccactccagcaagtatagctaaaaaaaaaaagggggggagggcgcggggctgggcttccagatgactggatcccactcccaggagaggaaatgctccctgacaggtgaggggacagatttgaggctgcacgtaaggctggacagaatctccctgggcctagactgcacctgtgttcacctgggagcctggcaccaagaggggcagaggcagacacagagctgctcagtctagcaacagaggagacagaagacaggagtgggaaggcgccgtctcagacccgttctgatgggcaagccaggctcatggctgcagggggaaaaaacattcactgccgcgacctgaaggcacaacccagagctccagcctctgcatcctcacaccctcaacccccacccagggcccaagcaatgcagaccaggtcctctctgatcactggcatttttcagcctgggagccagccttctagaacattttcccgctccctcacactgggtcactcaggcacgttaacgtgcgcttgtctgttcccttgtagcttcccaggcccccaggacagggcacgaacatggcctttagcttctgcctctgctggatctcccaagtagtcttacccgaatcactgttcttagctattcatttccagaaaacaggaaagaacctaagagccaaaggcaactcctacagatacagggtggtcaccaatagaatggcctggggtccaaaaaaaggccagtgaacgaaacttaacagaatccagatgtggccttggaagacacatggcagccccaatgcctcaatctgactgggctttcttgatagaatgttgttggacactgagcagggctatcgtgcttttataaaaggttgagtaaaccagagaaggcaggagaaacagaacctctccacagactagagaaacagggccaaccatatcaaatggagagagccatggctcataagcacttttcagcagccctgtcttcccccatgagcaaggggaagaggacacgggcttaataggaaatggagaaggagcaagtcccgaccaaaagattccatgctgtggccacccccggcccgccctgctgacgggtttcaggcgagtcaagtcattcaacccccagcccctgcatacacatggtgttcacataagctcactcctcagcccccagccggcagaaagccggtgtcccagcgccacctgctgactttccaggcctaccgcagggtggccagtggactctgggtgaacacgccccagctgtggaagaaaaaaaatgaggcagcgcccaggcaaggaagcaagtcaggtgacgcctcaggaaggcttcagtgaagaagaatgactaacaccagggcttccactgccctcagcgactcttacccaccagtctggaatcaggaaaacaggttacaactgggagagtcacctagagcagacccgagaaggctgccccaaagggctgccccaagtccattttggtacagctgcgtggccttccctgtagcctcccagcacacagacgctggagaagacgggaagaggagggctagagctgggggaaatggaggccgtttcaaatgagaacatgacttgtggcagctccagcccacgacccagatggagctcacccatcctgaggacagtgcactaagcgcagggcaaaggggcaggtgtgggtctggcctgtcctcccttcttcttgagaacaagtgacacagaccagctgggtttctggggttttgctgtgtatcttttttaaaaccagctatctgaggggtttggggtaagctggagggtagagagcaaccgactgaggtaagacaacttaggcaaaggtagtctgtgattagatgactcaacctaaaaaagaagaaaaagcagctcagcagagaagcacgggcagctccatctgggctaatggcagcgatgggattctaccctggaggggtaaagaggaaacaaaagatgcctgtggatcaagttcaggtcagcaaaaattcagggggcttccacacaaacaggggccttcctgcgactggctgctaaccagcactttgggcctaaccttgaccgtcatttaagctgagtaaggcagagaaggcagtgcaggtcctctgaacacacaaaccccagcccagagggagctgccgtccccaacacactccaagactcaagagggcctctcgctagctgtgcccccgaagtgcaaggttggcaggaagggaacaggagcgactgccggagtcttccacaagtggaaaccagtggctcatccagtgtggtcccctggaggtggccccgatggacccgccttcacaaactgtcatagctcctaagacctgaaaagctgggcttcttggctaaaaagcccaacaagttcaacccaggcacgcacctaaagctgtcgccgtcagcccgggacagcccattcagtcaccaaatgtttcagcgcccttcatatgtgccaggcccttggcactgagctgaacagtctgaaggggaagagcccaggttttccacgatgggcaaccctgccaagtgccacacctcagagctgcgtgtgcaggctgccctgggacccgaggacagcgctatgggtcagccgggaacatggtgtgggcccctcggaacaggctccacagggaagcctcggagattcacgaagaggaggtgccggctgggccggcagctggagggggtgttccgcacagaggtccccaaaatgctcagagaatcgagttgggggagagcatgtgttacgtgaggctctcccatgagacccacatgactgcttcatgacagggggaggccgaagcagagactgtgggggagccgcgtcctggaggatccatgtgatagcgagccactggaagtggggtgcacaggccaaaggggggaaggcaggtggcagggagcccgcttggtctatacgggatggtggtggccccaccacagcagtggtcccaagggttgtgagagagaggcttaggaggtgacatctacaggctgtttcatgggtggagtccagctctgcaggctgaagacttctggaggttggctacttgacaccgtgaaagcgcctcaccctgctgggccacacactgagaaatggccacgatggttgggcagtcacatgggacaagaagaaagggcagagcagccccaggcttctgggtcaagtgacaggactgagacagtagtggcagaggcaggacaaaagctcagaaggctttggctgggaagctgggactctcccactgctatcccaggcagcagcagcagactatggggggccaagggtacagacttgcttctaggtgtgatgtttcctttcaggccaggccccctttcccaattacaaaggctactcgggagctctcaggctaacctcctatgtgttctgagcccagtcccgctgaaaactagtgccaagcaccaggccttctccagaatgtgctcccctccttggccactaacctgctcacatcctccttcttgatcttgcttccctcttccttctgctccccgatcttctatcgctctgctggaggctggaatccatcctgccagcacattccctttgccctggcctcaatgcctctgaagccagcaacccaagctcgactgcccggaagcaccctatcctgctcatctgccaggcctcccctgctcaaccctgctctccctgtcccctcctttccttgctgcccccaggcctggccagaagtcccactctgcaaccagccctcacacctagcacgatagtgttactccatgggcagccagagctccctttccagcagggggctgcgtcctcgcattccgcaagtccacagcagaaccaagatcatctcagactcccagagactggaaaagcctgctgattcaactccacctgggcctctcagctctgtcccctccaccccacttctactaccactgtaccactgcccccgttcaggttcccagcaagtctcactgacaacctccaacttggtctccccacttcaggctctcctgctccactccaacccatacacccttgcaaaatgttaatccacacaggtgactgcatgccagcagtactggaatacccactaggcaggctctctaccacgcagaaaagttgcatacgaagtctggaacccttaactcctaaccatctaacctgctcgggccatgagtacctgctcgcgccatgagtacctgctcgcgttcaagaactgagcctctcagtgggacataaagaacatggaaagaaagagaggtgggtgtggtggctcatgcctgtattcccagcactttgggaggccgaggtgggcagatcacatgaggccaggagtcagagacgaccagcctggccaacagggcaaaaccgtctctactaaaaatacaaaaattagccaggcgtggtggcatgtgcctgtagtcccagctacttgggaggctgaggcatgagaactgcttgaacccaggaggaggaggctgcagtaagccaagactgtgccactgcactccggcctcagcgacacagagagactctgtctcaaaaaaaaaaaaaaaagaaagaaagaaagaaaaagaaaaagaaaaaaatcaacagcaacaaaaaagaaagagacagataataggagtggcatgggtgctccaagaggatcaggaggcccaaagaaagctgactagctgaggccactgtttatgacatcagaaacagagctgcaggctcgacatccaccaatgaggaattgggtagacactcaagaacactcaagaacgctggagaggccaggcacagtggctcatgcctgtaatcctagcactttgggaggatgaggtgggaggatttcttgagcccagcagtttgagatcagcttgggcaacagagcaagactctgtctctacaaaaaattaaaaaattagcagcacgtggtggcacatgcctatagtcccagctactcgggaggctgaggcaaaagggcggggctgcagtgagccatgatcacaccaatgcactccagcctgggtgatggagcgagaccttgtctcaaaaaaaaaaaataaataaataaataaataaatatgctggaaacaggtcagttgtcccagaaaaacattcatgataaactgagtagaacactcaagtcaccaaggggcatttaaagcatgtggtgcttaaaagccccgtggttaactttttttaaacacgggaatgtttttaaaaagcatgtggaggctgggcgtggtggctcagctgccgcactctcccgtgttcccatccagtagcctgatccaaaaaagccatgaggttggtcttgcgtgacttcttagaaaaggaaacggtgatcccagagatcagtgtggattcaccagttgcccataagcgatctagttaatcatttctggaattttgccagaaatatatactccttgctagtctaagagttaaatctaagatggtggctgtgaccctagaggaccttggctttctgtgtgatgctcttgtccagccttatggccacacagcccatttgcagcttgcaggaaacactgaaaaaacaaagcaggccaggcgcggtggctcacgcctgtgatcccagcactttgggaggctgaggcaggcagatcacctgagctcaggagtttgagaccagcctggccaacatggtgaaaccccgtctctactaaaaatacaaaaaattagcagggcatggtggcgggcgcctgtagtcccagctacttgggaggctgagacaggagaatggcgtgaacccgggagacagagcttgcagtgagccgagatcgagccactgcactcctgcctgggcgacagagtgagactctgtctcaaaaaaaaagagtgagccccctaaggcttctatgtgtatgtgtggatagagccaatccacatggcagccactcatgtgggttaggaccacacctaactacactgttctgccagcaccttccccacacttcggcatctggtcgttaagaacagactcagactggcaagcatcatgctaaaaatccatctacactccatctatagaaggctgacagaacttctccaggaattcacagcagtcaccaatgatcccgctcttcttttccaaaagcatacaagctattctttctagagcatggctggagatcaaagtcaaccctccccaggtcaattcctcatctaccttctcctccctttggaaattgggatgtttgccaggctgcagtctgccagtatctctcccactctgcaaatcctcaagcatcggtggcaatgccttctgcagatgatctcaacagcttctggacataatctcatcaagtacatcctttagggatgccactcttgcccacctgtaatttccattttctcatcctagtgtttcctttgcccttgaccacctaccctccatctccttccttacacagacatataaaagggactgccttctcctcacttctccatgtctttcatgattcagagctcccggcaggttttcaccttcccgatactattcttttttttttttttttttttttttgagatgtcacccaggctggagtgcagtggtgtgatctcggctcactgcaacctctgcctcccgggttcaagcaattctcctgcctcagcctcccgagtagctggcactacaggcacctaccaccaagcccagctaatttttttgtattgttagtagagactgggtgtcaccatgttggccaggctggtctcgaactcctgacctcaggtgatccacctgcctcggcctcccaaagtgctgggattacaggcctaagtcaccgcacccagcccacccctcccccataccattcttaaagctctagatgcttttctggtagatggcctagtttcctctctttccctctcaatgtggtcttttttcctcattttgctgactgtcacactcagaattctgggtttgagactcagtctttcagatctgcttccctttcagcctcagaccacaagataatacttgtttggaacttcctgaaaaatttagggtatgtgtctgactcctcccagccttcctgactttcctaagtttgaagacagcaagcttgtagatcaaatctgtgatcaaacccattatcttgaaaaaaatgtgtttgccttttctagctccacccctctttccaacttggtcgcagagagtaccagatcatctaaacaacagattttaagacaagtagtcatcgtagcgcctagtaaagcaggacacaccaggtgactagagagcaagaatctcctaggcatggagattcttgagtctcggggcacaaaaccaagtggggaataactgtccatgagcctgagaatcacttggtgctatggtctgagtgcccttcaaacttcatgtgttggaatttaatcctcactgccgtagcattaagaggtggggtcttttgagaagtgattaagtgatgagagctccaccctcaaagcaagcgcctttccaatgccttcatacatggtctgagctcccatccacctcccagccaggccctgctgatcagaacggctatgtgaagcaggaggcagcaaacagggccccaggctcaaataggcacttcgtagtggtctagttttgcccgactagttacccttagccttgattaaggtacttagttttaccaaaaaaatcatcagaaatactctggctgccatggaatgtaacatgtcctcattacgagtttcacgtggggaaggccctgaggtgaggagaggcccagcctcttcgtgccacttttacctgctgtccctaggtcaacaccccggacacaaagagtcccccattcagtcgctcccttgtgagctggactctgaaggtcctctcccagaggagggcaaggccttaccgttacatctcactctccatgcaaacagaccgtgagatagtcatctgtttgcctgagagtatgtggtgtgtgagggtcttctgatatttcaggcagccctctcctactctccacgctgcctctggaggtcaggagaaaactatgtggcttccctaacacagacagggctt

SEQ ID NO: 3351 - DNA, 270 bp, Homo sapiens
  Genbank Accession No. U36922
gccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggcttggtgtctttcttttctaattatgcagaataagctctttattaggaattttttgtgaagctattaaatacttgagtt

SEQ ID NO: 3352 - DNA, 9980 bp, Homo sapiens
  Genbank Accession No. U37055
ggatcctgtaatatgcaacaacatggatggaactggaggtcattatgttaaatgaaataagccaggcagaaaaagacaaacattgcatgttatcacttatttgtgacagctaaaaattaaaacaattgaactcatagaggcaaagtactggatggttaccagaggcttggaagggtagtacagggcttgtggggagatggggatggctaatgcgtacaaaaaaattgaattaatgagacctatctggtagcagaacagagtgactatagtaaataataattgtacatttaaaaataactaaaagagtataactagattgtttataagacaaaagataaatgcttgaggggatggataccccatttaccatgatgtgattattacgcattgcatgcctgtatcaaagtatctcatgtaccctataaatatatatacctactacatacccacaaaaattaaaaattaaaaatgtaacacaaagaaagaaacagaaaagaatcacatttgaatagtcatgttaaaataacaagatagcaggtgcttttccttctttttttagagacagggtcttgctctgtcacccaggctacagtgcagtggcatgcagaggccaactcactgcagcctcaacctcctaggctcaagtgatcctcccacatcagcctccctaacagctgggactacaggtgcacaccaccatgcccaggtaatttctgtattttattgtagagatggggtcttgccatgttgctcaggctggtcttgaactcctggactcaagcaatctacccaccttggcctcccaaagtgctgggattacaggtgtgaaccactgtgcctggccctctaagtttctgctaaaatgtacttgtaacttttatactgactacacttaaaagtattaaacttgtaaagaaaaggccctggaggagtttgttctttacaaggtcagtcagaagctacaaggggccaggctggggccaaggtgagggcaggtacatgcaggggcagatgctgggtatggagtaggtgccaggtgctagctgggcatgaatgtgcacccgctccctgacctctgctccctgactctcagaaggaactagcactgcctggagacaggaagaagcagagtacggaaggcagactctctggccagagatctcgcagccaggagcacagtgagaacagagcctaagcctatctgtccagagcccaggctccctttccctacaactgcagcctccttattctggtctggcccagcagagtgaggaggggccacccacccagccatacctgctggtggctgctcggggtgcatgttcagaagaggaaaagatgcggttcaggtagtcattcagcagcttctcctgcacaatgcctgagccacaagtcagaagggagaaaagggccacatgatcagtgcagctcctggcccctgctggccccagagacttctggtcctaggccagccacaggtgcagcaaggcctgaggcctttgtcccttccttctcctcccaacaagaggagcctccttccttccctgccagctcttacctgtgaccctggatttctcagcatctgaggtcagcctatagctcttgcgggagaaagacatgccggcccccttggatgccatccttcatctctcatgggcagccagtggtcctgggggctgagccagacacagagcctgtctactcagggccagccaggggcccccacacctgacctcagtcctgccatggcaggaaggcttgggagcaggtgaggccaggggcatgcacactaacacatagggcaggggaatgcaggggactcccagcttcctacacagggagggtagccagggtctaggcccatgtaacagggaccacttcttgttctccagtgtccctgtgacccagcactagggactgggcagagagcaggtactagatatatttttgccgaaccataacaaaatgtctcagctctgtggaaatcagaccaaaatgtccaaagtgaggtgtccttgggtagagcccctgtatccatctcagttgtaagccatactgagtccagctcacaaccagaagcgacaatcctacacattcccccaagtgcagaccaccactggtctggtcatctctagccataagtcccacttactccccacaaggctggagcctctttcctcagccctgggttcctcccttcttttatccatggtcctgatagtttcaccattcccactcacacatgtggcctcccacctcatccaagcaccacccttgcccagccctcatggcaaactccattggtcctcctagtgcatctatccctcacatcatgttgctgctgcagctgctccagaacctgcactgagtccctggtgctggcctcactgatgtgtaggcgtgctgtccaacacagcagccgtcatccacatgaggttacttaaatttaaagttttaaaaattaacaattcgatttctcagttgccttagccacatttcaagagttcaatgaccacatgtggctaatggttactctgttggacagcacaaaggtagaacgttcccaccatcatataaagttctattagacagcgcaggtctagagtttcgctctgcagcactgccttagccagcactccctactctgcagttcagtctcttatctcaccccaaacagaccctctactcccgccacaaacccttgtgggtctgcaccacgcctgctcctcgggaaggtgattttcccgacctcgggccctcggtgggcgtccatgatcggtgccccttcactaccagagtagttgaagatctgattaaactcagtcattcatttgatgagcagaccttccagacacccggagtgggctccgggagtcagttgctgaggacccaggtgagaggcggaccttgtcccgcccgggactccctgtcacggctatcccgtccaaccccgccggggtatccggactcagaactgaacctactccgtctgggagcccaaggacggcgagggcgggcatggctcccccaagtcgcccccgcctggccccaagctccacaggacctgccagaccagctttccgctcggagtttcgcacccagatccctgcgctgcaggtgccctcgcactggactagcccggaccgcgaagggaatagccggaacccgccagctcagagccctgccgcccctcactcacccggagcctcggccgcagcgacccggctcacaacatccgcccaacctcttggctacggtgtccgttcagggccaaatcacgcgcacgcttgcgcgctgagcctccagccgcgcacgcgcactggcccgcgcccagcctccgctaggggaccccctccatggcttcccaccggttgttccaggcctcagcttcgccgaaagcctcaccacctccgacctccgcctgccctggggatgctcccagccctcgctgcggcagaacgcgacatgctaaccggaatccctaggccgcctgtctcctacccatacttagaggccccgctcagacggtccttaaaacgtctgaaaggccgttcctgccagagtccctgctacctgttacctccacccctatttagtcctagtggacagcctcgctcaccttccctgggatgacacttctggcggctgagatgagcgagcctctctggctctgccgccgggtgtgggctgacctgcctacagctggggcctgataaggcagcagcaaaagggtggaggggaggcagtgttgaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggaccctgaggcctggcccctcatggctcctgtcaccaggtctcaggtcagggtccagcaggccctgagctgacgtgtggagccagagccacccaatcccgtagacaggtttcacaacttcccggatggggctgtggtgggtcacagtgcagcctccagccagaaggatggggtggctcccactcctgctgcttctgactcaatgcttaggggtccctggtaagtgcccccaaccctgatccccatctgccttcaggagggggttggccccattctcctattctaggatgagaaaaaagtcgggagcagaggctcagtgggcatggggcagtgaccttgccctcttgagcacagctgggaagccctaggaacacatagacattgcccacttaggcctctattagcacgtctgctctagcactgaagcagtgtcaggaccacacagatgcacgcacacagcaggcagtgacccctcctgagcctgatctacccctctaacctagcatatgcctttgtgcaggtgagagcccagatttggagtctgaatgcctagccagggcccttggctgggtaatgtgatggctctgagccttagcattctcatttgagagatgaggtggggcaagcttcatcacccactgctctcacagagcgtatgtgttagatctgagcccggtgcctgggccactaaacagaggcaccggtgataactaccaagtctgggcctgcttcccaggggaaatttttttcacaagtatctgtgcagggggctagactggcccttgaaagtgcatacagggtccatcccagaagcttgtagctttgatcccctgaatgaacaaagtgtggacatgccaatacacattactgacatgtatgcccacctgacctgcacccactcatgcctactctgcagggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccggtgagtggccactgggctagataagactgggggcagggaagcctgggctgtggcgttaccctgtgccttcttctctccagggccttccactacaacgtgagcagccatggttgccaactgctgccatggactcaacactcgccccacacgaggctgcggcgttctgggcgctgtgacctcttccagaagaaaggcaagtgggggtggagaggggcagggtgggagacaggggacctcagcccaagttgatcttctgtctcttgctcccagactacgtacggacctgcatcatgaacaatggggttgggtaccggggcaccatggccacgaccgtgggtggcctgccctgccaggcttggagccacaagttcccgaatgatcacaagtgagacaaacaccttccctccgtcccggcctggggcttcccccagcacacactatagtgatgctctgggccctcaggtacacgcccactctccggaatggcctggaagagaacttctgccgtaaccctgatggcgaccccggaggtccttggtgctacacaacagaccctgctgtgcgcttccagagctgcggcatcaaatcctgccgggagggtaagcggcgccgggtcaagctgggagagtggagacaagcccacgtccatccacgaacccactggctctttgtctccagccgcgtgtgtctggtgcaatggcgaggaataccgcggcgcggtagaccgcacggagtcagggcgcgagtgccagcgctgggatcttcagcacccgcaccagcaccccttcgagccgggcaagtacgcgtaggcggtatcggcgtcctgggggccgggctagggaaggtccaggactccaggggcagggctccgtgtagggcaattgggcggggccagataagccagagtcccagggtcttgttcacgccccattaccgcccccaggttcctcgaccaaggtctggacgacaactattgccggaatcctgacggctccgagcggccatggtgctacactacggatccgcagatcgagcgagagttctgtgacctcccccgctgcggtaggcggcggggaccaggcctgggagggtacctgggaaccttggggaggggcgtggcttggccggggaggtaagaggggctgggcgtgacctgagagcataccccgtggagtaccgtacacctgggaaaggcgggtttggtcccagccccagagggatctcagctctcgctcggggcccgacctatctcggtccatctaagggtccgaggcacagccccgccaagaggccacaactgtcagctgcttccgcgggaagggtgagggctaccggggcacagccaataccaccactgcgggcgtaccttgccagcgttgggacgcgcaaatccctcatcagcaccgatttacgccagaaaaatacgcgtgcaagtgaggtggggggggggggcgggcgttgggacgtgctgctgcgggtgagacgggaggaaggtagtcacgggctcaaggctggaggctggcgggctagggctgagtggagcgcctgcttagagaccttcgggagaacttctgccggaaccccgacggctcagaggcgccctggtgcttcacactgcggcccggcatgcgcgcggccttttgctaccagatccggcgttgtacagacgacgtgcggccccagggtgaggcccaagcttgggggctacagagccgggctggaagctggaaccggaggccggggcgaggtctcggcctgatggctgcccgcacccgccacagactgctaccacggcgcaggggagcagtaccgcggcacggtcagcaagacccgcaagggtgtccagtgccagcgctggtccgctgagacgccgcacaagccgcagtgagtccctggtgctcccggccccgccagggccctaaccctggggcggcatgctttggtgtctgggaccagagcctggaaatggttgagactaccctgccacgattttgctcccgcttccgcctaggttcacgtttacctccgaaccgcatgcacaactggaggagaacttctgccggaacccagatggggatagccatgggccctggtgctacacgatggacccaaggaccccattcgactactgtgccctgcgacgctgcggtgagcactagtgacgcttcccccatgaccctgcctcagcccccacccaaaggctggctcccttaaccccagtgaactttgtctttcagctgatgaccagccgccatcaatcctggaccccccaggttaggagttgggccagttatgggtcaggccctttagcccacgacatccacacagtctgggtttcatccagcccaccccatcctacagaccaggtgcagtttgagaagtgtggcaagagggtggatcggctggatcagcggcgttccaagctgcgcgtggttgggggccatccgggcaactcaccctggacagtcagcttgcggaatcggtgaggcacaactgcctgtctcccacagagaggagctgaggttgtgtcctctgtggttatccactggggctgggaatctatccgtgccccttgagaggtcctagccaagaagatggcaggtcttacgaatctgtcccaggagtctgttacctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccccttccccaggcaagctaacaagtgagccttggggcaatggactgagagtcacaaatgacctagcagagcttctctcccagccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagaggtatgtggacaacctgggagggtgtgaggtggggctgggccttgtggcctcagaccctgagtgcccccattcttgctaaagatctgtgaccctgaaccagcgtgtggccctgatctgcctgccccctgaatggtatgtggtgcctccagggaccaagtgtgagattgcaggctggggtgagaccaaaggtaagagcacagtgcacaggactgctggtggccaggaggccagccctggatcttcctgcaggaccctctccctctccccattcccctcactgcaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgaggttggtggcagggcctgggcagccctggaagtatggggggctagaaatgaactattttatcatgaagcaggctagtcattgctgtggcccggggcctcatcagttctcctacctgccagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgtacagatgcttcttagcctttgcttccaggaaatgtgtcagtgactccttgctagggctcgggtggcttgagcccagcacaccctgggctaggtgatctgtccagcctaggggcttccccaaccaaggcaatgtccctgggactacttttgcccatgggtgccgtggaaagacagggcctcacactagtcctccagacatactcttgggaagggtggtacagagtagttgctaatggaaggggctgcagcagggaagctaggctggtacagagtcctggttgccaggacaggcagaggctaagcctctcactgttccctcccttctcacactggaggcagatgaagcccttgtggctgccacacccagaacctagggtctctgcaccccagagtgggaggtggggttggggatggtttggtacaaagtaccagcaggaaccaggctctgtgtcctaatttattatgactacatagcccacattcctctgcccatgcatccgtggagtccagagcccagaaagcctcctgctgccctgccagaccgttgagctcctcaagaggaagtgtggcacaggctgatcagctcatgcagaatggcagggcttcagctgcccaagtgtgtgcgtagccagagcacagcattcatgaagctgtctgactccacctccacctctgataatgcgtgggtgcttttgggatagagcaggagcctgtagggattagtcagcaacatttaaggttggagggtcctcctgtgctcacctgcccaccagctgccagggccttcatgctgcactcaccgaacaggcacattccgggtcttgagggcacggtaatactccatgccctgcttgaagggcacacgccggtcctcctggcccaacatcagtaacagtggtgtcttcacctgggtgtttggggaagagtggggagctgtgttgagctgggccctggattctggatggatgggcagcacacagggcaagcagggggctgcatacctgagggatgtatctgatgggcgatttgtccagcatctcagcccacacgctgaggtctggcaggcagtcactgctgaaaggaaagccagcctccaccacgcacctgcaagacaccgagctgttgcagccccaggaa

SEQ ID NO: 3353 - DNA, 1857 bp, Homo sapiens
  Genbank Accession No. U37143
gagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccggcccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagtcgagattgacagagtgattggccaggggcagcagccgagcacagccgcccgggagtccatgccctacaccaatgctgtcatccatgaggtgcagagaatgggcaacatcatcccccagaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagcaagaagacatggcacgtgttctgaaaccactggtgtctgctcagatgtgttgggacaaaatgaaagtgactttcaagaaagatcagaggaatttgactcagagaaaactagatccaaatcccagctctactgtctctcccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 3354 - DNA, 3532 bp, Homo sapiens
  Genbank Accession No. U37547
gaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgctttccaaaaaaaaaaaaaagtcgacgcggccgcgaattc

SEQ ID NO: 3355 - DNA, 867 bp, Homo sapiens
  Genbank Accession No. U37689
ccctcactaaagggacaaaagctggagctccaccgcggtgcggccgctctagaactagtggatcccccgggctgcaggtccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggaggccaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcc

SEQ ID NO: 3356 - DNA, 5173 bp, Homo sapiens
  Genbank Accession No. U38847
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgggtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtctggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacatttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggttgaagcagataaccaagcagagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtccaataaaaaaaaaaaaaaaaaaaaaaaaaaaaaaaaaaaaaaaaaaaaaaaaaaaaaaaaaaaaaaaaaaaaaa

SEQ ID NO: 3357 - DNA, 7465 bp, Homo sapiens
  Genbank Accession No. U39226
gctctgggcaggagagagagtgagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcagggagtgccgtgtctggctctcactgggctgctctgatcttggctgtgctgcgcctcactcaggctgggcaggactgaccccggcggggccctgttctccgtgttggtcctgcaggggagcgaaaacgacggcccccagcttcacgctggccaccatcaagggggacgaatacaccttcacctccagtaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgactgtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaggtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcatcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctgaaa

SEQ ID NO: 3358 - DNA, 2821 bp, Homo sapiens
  Genbank Accession No. U40990
ggcttcctcgagcgtcccaccggctggaagttgtagacgcggccctggacgtgggtgcgcgccaacaccgggcggcgcgtgctgtagatggagacgcgcgggtctaggctcaccggcggccagggccgcgtctacaacttcctcgagcgtcccaccggctggaaatgcttcgtttaccacttcgccgtcttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccaccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcaca

SEQ ID NO: 3359 - DNA, 2740 bp, Homo sapiens
  Genbank Accession No. U41767
cgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccggctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgttaaaaaaaaaaaaaaa

SEQ ID NO: 3360 - DNA, 2442 bp, Homo sapiens
  Genbank Accession No. U42408
gcgggattccgggccgggccggcctgggctgcaatcaatgcggctttgtctgggacgcccacatcccagaggccattcccgggtcggcaaatcggagcgcggcggggcgcgcgggggtgagataagcggccatgtgatcccacctgggctggaaggggaggggcgccaggtgaggcggcggccggtggggcgcgggcggccacgcggggctcctgcagcatggctgtcagcaggaaggactggtccgcgctgtccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctggcccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttcccttgttggctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccaacaagtgcctctttgtctatgatgtcccccttctctgaggcctggacccacccatctttgtccctgggggctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 3361 - DNA, 6353 bp, Homo sapiens
  Genbank Accession No. U43901
  unsure (1)..(6353): n = a or c or g or t
taacgcatacgatcagttcaatcttgtcttttttaactttttcagagaaaacttcccttaagtgaacatttaaatctgaattacgtcctgttaaactgttctccaggaaaataaaataaaataaatcttcaagtttttgtttacctaacaatttgttgtgtcgaacaaaccttcctacttttcaggtaacaaaatggcagcttaggctagaaagcgctcatattcgcaggtacaagggctgggtaagaacgccccgcctggctgactaacttgagttccgcgctctggacaggaattatgcacagggcgtcgctgtggcactagaaaccccaaagtcacaagcgccccagatccgaccaggatgccgctacccgtgacagcccagaagcccgctcctgcgcgcaagcccgccttcctgaagaaaaagcccagtcccggcagcgttcttctccggctccgcccttcttccgctcgactttctttgccattggctgacaacggagtacataaggacgtcatttcctgctgcctgtcttttccgtgctacctgcagaggggtccatacggcgttgttctgggtgagttccgtgtagcgtccctggcgccttccagggctagaaaaatgagcttttcctgctcaaatgaagggtgagaagactagtgatgaaagccggtcagactggatctgtctcccgcccggcgcgccccaccttaggcctgccgggcacgtggcaggctcgggcggcgggttcccagagtgccccgggagcgggtggaggccgccctccagcggaggctccgagctggggttcggaccaggccgcgggtgggcgggagtgcagaaagcgggctaacatcctgtgttgctatcttcggagtcccacacggcggtgagtcgaggcccaggcgctgatttacaccagctacttgggctggtcgggttttcccttcgcgccgtgcgggtcaggagttaaggttctcgggtttttagacaaacaagtggtgacagcacagcgaagtaattccaaagcatccgcctaccaatctgcttgaaaatgtctgaaaacaattcatgccttttttgcctttagtttgcatattccaaacatggctgctcttttatatctagttgttaacttggcgcatccacaacttttccttaattcctatcttgagaagtgttgaatttccattcgctaatttcgtgtagttttattactcggttactctgccgtccacactatttcctcagtaagatgtgcgctgttccgtaatacacgacatgtatgggttaactttctgtttacccttcactacactgtaagctcaatgcctgacactatagcagatggagtttttggttgcttttaagggtgtgccctacttaactcaatggaatgaaaagaaataggttgctctcttatttcagattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgagagagaagatttctgctccaggggagaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagttttaggatgaatcttgcatcagtgcagatgataaaagggaaagagtggcagaaagccagaagtgatcttaagaaccaatgatggaataagtacagggaaagagaaaggaaagatggattagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggttaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccaggtttgtggaacagtggttagtttttatattatagaaataaagccttacagacattgtgagacatatagaaagacataagaaaacagaaataactcaggcccggggcgcgtggctnacgcctgtaatccccagcactttgggaggtggagtccagcgtattacgaggtcaggagatccacaccatgngtaagccccatctctactaaaaatacaaaaaattagttgggcgtgggggcgggtgcctgtagtcccagcctactcggggaggccaaggtggagaatggcggtgaacccggtgggcgggagcttgcagtgagctgagatgccggccactggttactccaggcctggggtggcaggaggccagagctctgtctcaaaaaaaaaaaaaaaaagaaatagtaaaactcaaactccactgttagagatcttaagttggactgagccatagaaatcgcccttatgacctatgaccttccttttttttttttttttttccttcaaagacagtctctcgctctgttgcctgttggcccatcctggactgcagtggtgtgatantcggctcattgcagcctttgcctcctaagctcaaggattctcctgcctcatcctcccgagtagctggaattccaaggatgtgccaccatgcctgactgatttttgtatttttagtagagacatggttttaccatttggccaggctggtcttaaacgcctgatctcaagtgatcctcccacctcggcctcccaaaagtgttgggattacaggcgtaagccactgcgcccagcctgtaagaccttttcaacatacatgctgggcatctgggcaatatgttgaactttataatttcattttgtgtagacttggtggccactaaatatctagaaattctattaaagtggcttatcacattttcccatggtcaaagtttttaccttaaaacaatgaaatacctgggacagaaattttttaagaatcttaggccagtcatgatggcatgcaccccatagtttccccgttaattgggagtctgagccaggagatccctcaagtccaggagctgggggctgcagtaagttatgattttgccactgcactccaagcctggggcacagagtgagatcctgtttcttaaaaaaaaaaagccagtcatgggtggctcatgcttttgtaatatggggtactttgtgaggctgagggctggtggcttgcttgagcccagaagttcgagaccagggtgggcaacgtggcaaaactccgtctctaccaaaattaacaaaaacgagctgggtgtggtgttggcgtgcctgtagtctcacgctgaggctgaggtggggagattgctagaacacaggaggttgaggcagcagggagccaagactgtccactggcatcccagcctgagtgacagagtgaggccttgtctcaaagagaacctctgccaacttgaatgaaaaataccttaatttgtatttttaagaaatgactagttagtaaaacttgaatcttttttgccacagctctattttaataattttttctgttgagaaaactagtagatttcttgaattctaagagttctaacagggattttattcatcttaactattttgacagatttaaaaattatgtagtaagactttatttcaatgttgacaggacggttcccatgtgtgtttttgcagagggttattcctgaaactgacttgttactaggaccacatagtttggtacacagtagaaaaaaggcagttagttattgctgtagaatgaactgagtgacagttcttgcttgcttgagaaaataatactgagcatctagattgggccaggtagtgttgctaggtgctcgggatatatagtagaaaaacaagcctgtcttttttaatgtatgcaggaaatctctggagaagtaagaggggttaaggaaagctgggtatgtgcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagtataacattactgcatgacagctttgtggagaaatgaaaacatttggaaaatagtgtgttcttctgcctttgtccgtgtttcttgcctcaggcctcagcgacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcattttttttcaatccctatgattccagtgtgcagacaaggttgaaaatccctatttataatgctccctgttacaattgcttttcaactaagagatgtctgtacttttggtacctagatgatgtaagagccaggaaggtgcttgctgtttgggtttgaccaagtgtcactttttaataatctgccactcttggcagggagctcactcagtgggtttaatgtggtggatgctggctcgggaagttctgcgcatgcgtggcaccatttcccgtgaacacccatgggaggtcatgcctgatctgtacttctacagagatcctgaagaggtaagcttctccaaaggcttgtggttacataagcaaattggacgacttggactgctgtctaggaagcaaaacttgtcagtccctgtaagtctcttcctcttttttttttgtaacccagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactggtatgtatcaggatagaggtgaatcaagctgatattttgcaacttctcagttttattctaactttaatgatctctgtgacttttatactagctttaagaggttttcattccagtgtgctacagcatctgatagactgctgttgggagtggggtaaggaaaaatactacattgaggacagagctgatgggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtccttcatttagtttgctttttactccagatctagaatacctgggattgcatatcaaagcaagtaataataaa

SEQ ID NO: 3362 - DNA, 1201 bp, Homo sapiens
  Genbank Accession No. U44111
cctagttaaaacagcagcccatcaaagtctttaaccctcttagcatttactcagattactttttcatttagcatttatcaccatatatttacttatttttctctctcctcctgtactccttgaaatatgagctgcacaaaggacaagattattattttgttctattctaagcatctagtgtactttctggcagactgcaaatgaaagaaagaataaatgaaagcatgacttgtgttttattgcacaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttgtttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacatgcaggctcaacataacataagctagaaaaattagatgactgaatttctatggcatattgataataaaattcattccatttgctgattgtctgaaattttctagaatactaataaaatacatactatagattctttattagtgaagtatgcactaatcaatactttgaacacaaagcctgtgttactgatttggccgttttgtgaagaaacatttatctttgtacgttcttctattgtgctttctatctaatttttattaatttgtaagagtaagcacctttagaatattaaaaattaattctttatcacatgttgtcatttcttcccattgtgttttctcttgtaattttatctgtgaattaatagcttggggttggtct

SEQ ID NO: 3363 - DNA, 2655 bp, Homo sapiens
  Genbank Accession No. U45285
cggcgtgcgcggacgggcagccagcagcggaggcgcggcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgtttggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatcgctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaagccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcgcccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcaaaaaaaaaaaaaaaaaaaaaaaaaaaaaaaaa

SEQ ID NO: 3364 - DNA, 233 bp, Homo sapiens
  Genbank Accession No. U46499
aacattaggaaaagaagtaaaaaaaaacttgtatggaattcctacgtagtcaattgtctaataggttttgtttatggtacttcagagttgctcaaactatgaaacctaaaatacaacacagtgacttttctcttgagttggcacatctaaatgaacaattcacaaatgtcattaaaaggtactgtttgagaaatacatatttaaaattaaaatgcatcaaaagatatgaaatc

SEQ ID NO: 3365 - DNA, 3931 bp, Homo sapiens
  Genbank Accession No. U46689
gcccgggcgctctcagcaggatggccaacaccttccctctccatccatacaccccgccgccccctggcccgtggccgcgctcggttcccgcactgctcattccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctcgacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaacctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagtaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaaatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacatctgcttcaaaatgaacatatttcataaaattggcatcaattttaatgacgctcctggtatggaacctcagatataccctattggagacaatcctttgatcataaattctccccaactataaatcattttatgtctttaaaaaaaaaaaaa

SEQ ID NO: 3366 - DNA, 2822 bp, Homo sapiens
  Genbank Accession No. U46692
ctgcaggattgcccctactccgactgccccttccctatcgtcccaccctgcgcgcccaacccaccggcgacacccggccgcgcccccgccccggtccgtgtgactcggcgcccggaaagacgataccagccccgggaggggggcgctccctcccgacaccagcgctgggcgcggagacccagcctgcggcgagtggtggccaggctccccgccccgcgccccgccccgcgccccgccccgcgcgtcccttcttgcggggccaccgcgaccccgcaggggactccgaagccaaagtgcctcctccccgccccttggttccgcccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgggtgggccgcggggacggggccggcccggagtcctgccttagcctcagggcgcggccgcggctcctggagcgaaagaagccgctttggccccgctgcgcacccctgggctggcccgggctgtggccgtgagaggcctccctccgctcgggtcgcgcgcgagtgagcagcggggggccgcgcctggggcgccgctggggagacattgggctccgctgaatacagcaagggcgagtgggaattgatagcccggagcagggtgcggtccctgcatggacagtctctgagaggaaaccccagggatgaggcgcttctggtttcaggcaggcagggtgatcgggcgtcgccggcgatggcgcaggtgagcagccggctccgatctccacggtgatccgatagcaagcgggtgggaagggtctggctaaactgacttagccaggcttcttgctaaaagtggattttacaaggaagtgcgcaggtggcctaggcgcttcaggagcccgactacagtttggccaagcaagaatctttgtcaatatcctcatctagttcgggaaaaaaatcatgagagagagtgcaagaggtccccagtgataaggcacatgggttaaaaacttaagtgtatctgcataaaaggtccacaggtttctttacatgcttccgattctagcactgtttcaaactgtaagtctaaataaaaagttaaaacacagaaaaacaagataaaaaccgggctgggttgcagatggcaactttccctgtgtctcggtttcctcgtctgtaaaatggacgtcctgttgctctgcgcctgccagaagattctggaggggctgaaatgagcaggtcatctgtgcaagaagccccctccggtggagcacaggccaggcccgcctcgctgtcatggttggtgaccgacgggatgccccaagcaagaacaggtccaggcgatgctgaggcctgtgttttttttttttgtttttgagactcagtctcaactcttgcccagggtggagtgcagtggcacaatctcggcccactgcaacctccgcttcccaggttcaagggattctcctgccttagcctcccgagtagctgggattgcaggtgctcgccaccacgcccagctaatttttgtatttttagtagaaacggggttttgccatttggctaggctggtctcaaactcctgacctcaagtgatccgcccacctcagcctcccaaagttctgggattacatccttgagccaccgtacccagctggaactgtttttttctactttattattaggctgacagtttaaatgtcccttcagttgtaagagacaattgtgtgaagagccagtgtcagaatcgtgtgtgtgctcacatgcgtgcaagttactctagcaggagggaatccaagaagccactgagacatcctcattctgtcccttctgtctaggtgaggtcccagcttgaagagaaagaaaacaagaagttccctgtgtttaaggccgtgtcattcaagagccaggtggtcgcggggacaaactacttcatcaaggtagagtgtgggcctcaggagggcctgccccgaacgggtgctggtaggaaaccgcctgtgcaggcccgggctgtgtggtcttaggtgctggggcgccctgtggctgccccctgagataagcatcctactgtgtgtgtccatcggcctttcaggaggactagggcttctggggagctaagaaccccaaggaaacaagtgtgggatgtgaggcatcccctgcacatgcaggagaagacaagattgtcttcagctggctgctaatgacctggaggggcgcagcaaggtgacttgggatcagaggcttcgctcactccgctctcttcccaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgctgtgcccttggggtggaaggggcaggattctgcagctgcttttgcatttctcttcctaaatttcattgtgttgatttctttccttcccaataggtgatcttaattactttcagaatattttcaaaatagatatatttttaaaatccttacagattgcctcctttgcttttagacttttttcttgctgctaaccaccccgggcaggtccttcccctccaggcaggagggcggagagagtc

SEQ ID NO: 3367 - DNA, 4066 bp, Homo sapiens
  Genbank Accession No. U47025
cctccatctcttttcctccgcctccgccggcgcgatgggcgaaccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccactggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggaccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcaggggcaggtctgtgccctcccgcttgactcctgctgtgtcctgaggtgcatttcctgtttgttacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccaaggctcgaacctgcctcccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactgccttgtgagataaaaactgattaaacctttgtggctgtggttggctgaaaaaaaaaaa

SEQ ID NO: 3368 - DNA, 2200 bp, Homo sapiens
  Genbank Accession No. U48296
cgggattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgtttttaactaaataacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgattttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattattttttagcaaaatgttgcctttgtcttgtgcaaacatgtagaatatgctctttaatctagtaaaatatttttttaaaaggtagagatgctttgttattgtaatcataaacttcctgaaattcttgtaattttttcccatacttatcagaagtgtgtttaccaacttatttttgtttgaaagtgtgattttttttttccttcccaacctctcttgcaaaaaaagaaatgggtttctgctaatgaattgagcagagatctaatattttatatgccttttgagctgtgtaagttaatatttgatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgaaa

SEQ ID NO: 3369 - DNA, 12010 bp, Homo sapiens
  Genbank Accession No. U48705
  unsure (1)..(12010): n = a or c or g or t
ctggaggaggacaaagggatgggggagtatcccccactcctcctacctcctggggtgacctgccttccttgtctttagacccgccctcgtctccaaggcaactcagcctttcctcagtccctcagaggcagccaccttctggaagtgggaactggggggactggatgtctgggtctcaggaaggcagagcagggataactgggcccaagatgccctgaacctgataagaggtggcagtcgagtccctcaggactccagggcctggagacttcagtacagggctctgagaccagtacaggttaggatagcttttcctgcagcaggggaggggagagtagttacttgggtttgtaaggagatgccatttagaatagttttatgtggggtaagcttcctgggcctgaggaacagagtagggattttcaaactttaatgggcacaggtcacctgggaattgtgttaaaaggcagatttggattgaacaggtcaagggtgagcctgagattctgatttcttccatgcttccaggtattgctgatggtccagggaccaccctgggcctagagggctatagggggacagtaagactagaaggtgctggggtcccctctgcccttctcttagaattctggactcctatgtgggagggcaacagggtgagctggtccaggcttatctgatgtttaattctatcatatcctcaacaaggaattgcccaacctttcctgggacatatttattttttaaaagtccaaatgattttcatattcttttacatatcttatgattttacataaatgcatttatgttacaagatttagaaaaatagtacaatcaacctgtctttttaaatttgcttttcttttgccccgttcatgttaactcttgttatattgtatgctattgttatattctattatatattctctccttctagacgtacacacaggtatatatacaaacatgggtgcttgtttattctattttcaaaaggtgggagattttttatacttctgttgcttgcttttcatattcaacagatatacatggaaatcacacaaagttaggaatatattgcctctttgttacttttcatagctgcatagtagtcaataaaccttattttttttaattccagcctgtcccctgtgggcattcacatatcttacagatttatgtcttacaaaaggtaccataataaacatctttgaaatcttcttttttatttttatttttcactttttttaaaagagatggggtctcactatgttcaccaggctggtctctaactcctggcctcaagtgatcctcccatctcggcctcccaaagtgctggggttacaggcatgagccaccagacccagacctgcacatatgttcttacttcctggtgcttctctctcgagggaatgctgggtcgaagaggatgtgcatttttaattataatagacattgctagattgctttccaaatagaagataacactcatttctgccattgagcatggtgcctcccttttcatcactttctaccacttttatatgttacagccttaaaaaaatatcttgtcagtctgcttggtatttccctgaggctagtgaatttgaccattaaaaaaaatgtttgttggcaatttggctttgcttttctgtgaaatgactatccacattctttggctgtttctttattgggttacttatatattttttcttgtcagttcctaaggggccttagtttattgtagttattaaaccttttcctgttgtatgtgttataaacattttttgcacacttgttgtttgttctaagccgttgtttatggggatattttgcccattcctgattggggaaatggggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgtcgctatgccctgggcatgcaggaccggaccatcccagacagtgacatctctgcttccagctcctggtcagattccactgccgcccgccacagcaggtacttggcacacctggcacacttgtagctgccccgagaggagctcctgggacctctacttcccctccaacccctctgcccacgccagtgaaacccctgcaggctgagggggcaaatgaagtggggtttaaatactggagatggaggcagacctggggccagatgttctctgtgcccctcttcaccctcaggttggagagcagtgacggggatggggcctggtgccccgcagggtcggtgtttcccaaggaggaggagtacttgcaggtggatctacaacgagtgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggaggggtgagtggctcagcttcctgggaatctgtttcctgagcaggggactggagggtggggagtgtggcgaatggacattttaggatcccttctcctggtgggaagctgtcactctgaggagggggctagccagcattgtctcctccatgccaatgagccagtggagagatacaagaagggacctgaaacctgcccaggcctgatgaagggatgggggatggagtcttagtgcctctgacccccaccctcttattttttcccagatggactcctgtcttacaccgcccctgtggggcagacaatgtatttatctgaggccgtgtacctcaacgactccacctatgacggacataccgtggggggtaagaaaggcccctgcaggatatggagtttggggtgggagggaggactctgtgtgtgtgtgtgtgtgtgtgtgtctgtgtgtgtgtgagtgtgtgtgtgtaggggggctggtaagtagggtggggagtgagatggaagagcagagaagagggatgggtaaggtgggncctcaaagggtaacactagggtgaccactagcccgtatgacactggatgtagaagagtcacccctttgctaacacacattgttggaaattgctccaataaatatacacatcatagattgaaatggtgccccttagaggtggtgcctttgtgctggatgtgacctgcaaggtacctgtagtgctggggtggggtggagagaggagaagggccagctgcatgagtgtgaggcgggatgggaatgggactagtggatgggagccaggctggccatgccactgtgccggagggtggcggagcagaatgcctggatgtcaagaccctcttcccttccaacctcctcttccttggtcccctcttctccggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtgagtgagtccggctctcgaggagggctctgaagccatgcagggtgccgttggggtgcccccaccactcctagccttgaccctgtgccctcttcccttccccccaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctggtaagccctggagtagcccagtctccagtccctgaaattgacaactgagttcattcctaaccctgcagtgtccctaaaatactcattcctcgcattatatctacccatcacccaccgaaacttctcaattaggggtgccccaaataacttgagcccctctctgcctcttgttctctgcgtatccatctttcctttgtaagccccttgcccgtgactattattgagccagtatgacagtactggttgttaaaatattgaaatacttctgtattagttgagaaatagcctcttctctaagcctccagatacctgtcctccacctccccacaatccagcaactatagggttaacacccaccacagctgggtgttccaggaccctgctcccccagcccccactggtcagtggttgcctattgagaatcacccatgcttctgctcctttgcacaacagtccactgcctctgcctcccttgggtctcctcctcatttacctccctcctttctttttgttccttctccccagatgtggtgaacaattcctctccggcactgggaggcaccttcccgccagccccctggtggccgcctggcccacctcccaccaacttcagcagcttgggtgagcaatcttgggtgggcgtgtggaccctctgcacccttctccctgggcctccccctcggctagggtgggaccctcctgtggtgctgaccctgctgcctccaccagagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtgggcacagccgtggcatgtggagtggcggggggaggccaggccccagcacgagccagcgtccagtgggacctgcagggcacagcccactagcatcccaagaggagggcttagtaaagagaccacttacaccatgtcaaagagggtatggggctcacagggagggctgctccccagctctgggtctgctcagcggagaggagcaaataccacgacccagaggagagagtctgtggagagggcaccttgacaggggcagtagactttggtcctgggatgcagctggtcccgttatctacccctcagggagggcctgggagagtagatgccctgacctcacttttctgtgccaaactcctgctgggctcctctctggctaaacccaaaccaggcctgttgttgcagtgtacactggtcacccttggggcagaagcagggtagagacaggcagagagtggggttggaggggcaaagggaagacgtctgncacaccccaagccacgtcttccggctggagtccagtggcagtaatatacattaaggttgatgactggacacggtggctcatgcctgtaatcctagcactttgggagaccgaggcgggaggatcacctgaggtcaagagttcgagaccagcctgaccaacatggtgaaatcccatctctactaagaataccaaattagccaggcatggtggctgatgcctgtaatcccagctactcaggaggctgaggcatgaatctcttgaacctgggaggcgaaggttgcagtgagctgagatcatgccatttcacttcagcctgggcgacaagagccaaattccatctccaaaaaacaaacaaaccaaaaaaaacggttgatagttatggactgggcagatgagggttagaatctcattgtggggcagggaagttacctccatgctcttgagcttcactttctctgcctgtaagatggtgctgatagtatccacagctgtagggctcttgtgagggctgagggagggaacgcagggatggacacagcagagggccaggccgtgtgtgctgagcaacacgggtgatgcctcccatccctatgacaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctggtaagacctgccttgttccagtcgcacctctgtcctctctgctgttttcttattgtatccctttcccattctctttttttcctgtcttccccagtttccacttgttttcttctttctgtgcccctggttactgtctatatcactctttggtccctaccatgtagtctctctcaagagttccccatgtattacccatagtcccccgtggtgctatcttgtctgtgtcccacagacatctctctatctttgttgtaccctctcattgtgtctccctggcccctttgatttgtattagactcaccatgtttggttccttcatctatcctccatcacccatccttccatccatagtcatacatccttgcatccatccatcaatcttccatcatctgtctttctatctatattcataaatctattcatccatccatccacccacccatatccatcatccatctatccatctatattcacacatccatctttccatctgttatccatccatccaacaaacatctgtttaccatccatccatctattcatacgtcccatctgtccatgcattcattatccagccagccgtccgtcactctgcagatccttgttttatcctgtctgtctcttaatgcaatcatcccatcagccctggtcttgccctattcaaggtctccctgtctgtctagccttgagtctcatcccttccccgtgtttcccctcctccttctcccgacagcgttgctgctctccaatccagcctaccgcctccttctggccacttacgcccgtccccctcgaggcccgggcccccccacacccgcctgggccaaacccaccaacacccagggtaagcccctctgcccctgggctccgccaggctccccatacctctactggggcagggaaaagccctcacaccttgcacttcctcctctccccactgtggcctattctgctctcctgagctcccaaggaggaagctcttgtgcccttagctcatctctgctgctgcttgctcttttttaaggtcccccccttgagctgaggagtagaaagcttactggtccccagctcttctccctcctcctcttccacgccatctcttcagctctccagagctagacaggaggttgctgtggtggccccagactatagtaactcctcctttattctccactctctctagagctgcgaggaggagggctctcaccccgggcgcttgccctttccctcacatgtgtcctctctctgcagtcccagaggtgaaggctcatgccccaaccctttccatctgcccctcttctcctcagtgttgccttctcattgtggccccttccccagggctaagaggggacagctctgcttcctctcctgtctgtagacaacttgtgttggggctgtgagcagctgttaccctccctcctctctgtgtgcctctgtctctgcttgttgttgagcttggtgtgttgggttgaaagggttgggagggcttggccccagggggagccaggctgaaagccacgggagagcagctaagtgaaggggagggagctgtggtgaacgggacaagggtttggaaggtggagggtgcctggatgctgggaccatcctgaggcgggagaattcctggggaggaattcttcttccagccaagatttatctcacagtctcttgagagaccctagggaggccctaaaagagtaagactttatgacagttttgctcaaccatattcattgccttgaaaagctctggaatagctaactctcgtcccatgccagtgtcttcctggtttgaggttggcgcatggaatactgggaagatacagcatagacccagtctctcactcaaccgggagacacagggccctccgggaggctgaggtgtggggaactatagctcttgggctgttcctgatgcctcgtcctgtcttctttcccctcacccctgcagcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtaaggagggtgcctacccagtgtctggccctattgtgtgctctgatgccatgcctgcgcatccccctagccaggaaccttagtcatttgtaaccgtgttaatccgtttgaccctgtgaccgcctagcaaacgaacttctttctccaggtgcacctgtgtgaggtcgacagccctcaagatctggttagtcttgatttcccccttaatgtgcgtaagggacaccctttgctggtagctgtcaagatcttacggccagatgccaccaagaatgccaggtgaggaccagggatggcatctggaagaagggaggggaggccgcgaagagtggcgagccatctagagagaacaatggcagagcccaacagaggggtggtatctctgggaggggatttacatgtacgctgggggtggggacgcctggtctgcctgaggtggcgcaggggggtggnggcgctgcggaaggtgtaggccgnccactcggcattcctcttcagcttctcctttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcaggtacctgtttacccaggctgggccatgctcagaattcccccaggggatctcctcctctcccctcgcttcagcctgggggaaaagaggggagcgtgggggtgggaagggagagaggttccaggagggcctgggataaggaatgtgtgacaagttaacccaggaatatggacagaaaggctggaggtgactatgcaagagtggtgaagggacttgggccctgccatgacgtcccttctgctttctctcaccctcactcccctctgagtccagattggggagcacaataaaagaagagccccctagtgttggccaggcctgggagattgagagagaagtgacccttggcctcacgtgggcattccacctccacatggggagccagagtgaccgggcccggggagtgggctctctctcctctcctggatgggaatctgcgaagctgcccccagtgaccttctgtcggttcccttctcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggtgagcagcccgaggacagccaggttggagcagggcaggtgggagaacactggccgccactcacagccctggtctccatcagtcacacactttctctgggttgcatttacagaatctcatctataatatgaggttctcctagcccaagggactggggaaagcaggagccgcagtgtgatgggcaagaatccaggagccaagagtgggtactggggatggagacagcgtggcagagagctcaagagatgaggttgggggaggaagctggagatagaaggggttgggtagggagaccgaaggtcaggaccagaaagtgggggttgggtggagaggaaggaggagcagaaggaagaggttggtccagggccccctggagagaggaaccagattcatggagacgganaagccagagccccaagggagaggagttggnaaaaggtgcccaccggaggagagtggagagcctgncntcaggagggatcagncctgagtggagcccagagtggatctggggcttccaataggaagggaggggggtcaaccgttgcctgatgtcccctgtctgtttttgctgccttcctctgcatcccaggggaagttcacgactgcgagtgacgtgtgggcctttggtgtgaccgtgtgggaggtgctgatgctctgtagggcccagccctttgggcagctcaccgacgagcaggtcatcgagaacgcgggggagttcttccgggaccagggccggcaggtcagagtggaggagagggaagatgggtccgagncgggggacagaaggggcagagttttcatcttggagactaaagaataattgttccctgactctcaaccacacttccncaatncaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgccccttcccctcccgacagcccatcacctctaatagaggcagtgagactgcaggctgggcccacccagggagctgatgccccttctccccttcctggacacactctcatgtccccttcctgttcttccttcctagaagcccctgtcgcccacccagctggtcctgtggatgggatcctctccacccacctctagccatcccttggggaagggtggggagaaatataggatagacactggacatggcccattggagcacctgggccccactggacaacactgattcctggacaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcaccccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttgggtttgtacatttttggggggagagacacagatttttacactaatatatggacctagcttgaggcaattttaatcccctgcactaggcaggtaataataaaggttgagttttccac

SEQ ID NO: 3370 - DNA, 662 bp, Homo sapiens
  Genbank Accession No. U48707
ccccagccatggagcaagacaacagcccccgaaagatccagttcacggtcccgctgctggagccgcaccttgaccccgaggcggcggagcagattcggaggcgccgccccacccctgccaccctcgtgctgaccagtgaccagtcatccccagagatagatgaagaccggatccccaacccacatctcaagtccactttggcaatgtcgccacggcaacggaagaagatgacaaggatcacacccacaatgaaagagctccagatgatggttgaacatcacctggggcaacagcagcaaggagaggaacctgagggggccgctgagagcacaggaacccaggagtcccgcccacctgggatcccagacacagaagtggagtcaaggctgggcacctctgggacagcaaaaaaaactgcagaatgcatccctaaaactcacgagagaggcagtaaggaacccagcacaaaagaaccctcaacccatataccaccactggattccaagggagccaactcggtctgagagaggaggaggtatcttgggatcaagactgcagtttgggaatgcatggacaccggatttgtttcttattccttcacttttggggaaaatctcttgtttttaaaaagtgataaatttggtgttaggtcaaaaaaaaaa

SEQ ID NO: 3371 - DNA, 5926 bp, Homo sapiens
  Genbank Accession No. U48959
ccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagcttcagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccggccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatcca

SEQ ID NO: 3372 - DNA, 2431 bp, Homo sapiens
  Genbank Accession No. U49082
ggcacgaggccgggagcagagcgaaccgcaccggcccgagcggagcgccgcacgttcccaaccgcgaggccagacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagagggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcattatccttttcctgttcctgttgacagctgtcgccttgctctccagctactccatccacctgctactcaagtcctcaggggtcgtgggcatccgtgcctatgagcagctgggctaccgtgcctttgggaccccaggaaagctggcagcagccctggccatcacgctccagaacatcggagccatgtccagctacctgtacatcatcaagtctgagctgccacttgtcatacagaccttcctgaacctggaggagaaaacctcggactggtacatgaacgggaactacctggtaatccttgtctctgtcaccatcattctgcccctggcactgatgcggcagcttggctacctgggctactccagcggcttctctcttagctgcatggtgttcttcctaattgcagtcatctacaaaaagttccacgtgccctgcccactgccccccaacttcaacaacaccacaggcaacttcagccacgtggagatcgtgaaggagaaggtgcagctgcaggtcgagcctgaggcttcagccttctgcactcccagctacttcacgctcaactcacagacagcatacaccatccccatcatggccttcgccttcgtctgccaccccgaggtgctgcccatctatactgagctcaaggacccctccaagaagaagatgcagcacatctccaacctgtccatcgctgtcatgtacatcatgtacttcctggctgccctcttcggctacctcaccttctacaacggggtggagtcggagctgctgcacacctacagcaaggtggacccgtttgacgtcctgatcctgtgtgtgcgcgtggccgtgctgacagcagtcacgctcacagtgcccatcgttctgttcccggtgcgccgcgccatccagcagatgctgtttccaaaccaggagttcagctggctgcggcatgtgcttattgccgttggcctgctcacttgtatcaacctgctggtcatctttgcccccaacatcctgggcatctttggggtcatcggtgccacatctgccccattcctcatcttcatcttccctgccatcttctacttccgaatcatgcccacggagaaggagcctgcaagatccacccccaaaatcctggccctgtgttttgctatgcttggcttcttgctgatgaccatgagcttgagcttcatcatcattgactgggcctcagggaccagccggcatggaggaaaccactagggtgaccctcatcctgttctgtctactcaccctagcagccctgcccagactcttcagcccctgctcccatccagtggccagtcgggggaggagaaagacgcgattaacactgtggcattcagccaggccccatgtcctctctgtggaaggtttttgttcaagagccaggaccaaggcccttgggccactaccctgctaggctctggagctgtagaggcttcctgaactgggagcagggtagggctgtcgccttagatcccgcccaagcccctcattccctccttgcacagatgcatacactggggcccagcagctgcctcctgaggtgacacagcctgtaggaacatacacagctgggatcagcctgcagccatcccccgaccctgctgctaggccacggtctgcgccctggggcctcatctcccccagcccacttgttttccccccttttattccctaggcccttttcagactcctgggcccttggatactcttctcccatctcccttcacaggatgacaccctcccataccccatagctggggccagcaggttctgctgagggtggggctggtgtagggacccccaagagacccctgtcctgtcccttcaccagtcctggggaggctgggactccccctgccacaagcctgggccacagctcacattccactgctgggagaagaaacaggccgaggcccagagtggcctgcccccgggagccaaagaccccagtggccacactgggatagggtggggaggctggcagccctcttttataaatctcgtgcc

SEQ ID NO: 3373 - DNA, 5300 bp, Homo sapiens
  Genbank Accession No. U49248
aggataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggagaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagttacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcataccatcatggacagtgacaaggtaatggtcctagacaacgggaagattatagagtacggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacttgagaaacccctcgattgtctacctcgatcgtacttccttgctacccacccctcccagggacaaccactgtcctgaatttcacgataattattcctttgcctttcatttctgttttatcacctttgtatgtatctttaaacaacatatacccttttttacttatgtaaatggactgactcatactgcatacatcttctatgacttgattcttttgttcaatattatatctgagattcatccatggtgatgcaaataggtgcattattttttttcactgctctgtagtctggcattgtatgaatacagcacaatgtatcagttttaatattggggatcattagcattattctcaggtttttaaaaattataagcagtactactatgg

SEQ ID NO: 3374 - DNA, 1149 bp, Homo sapiens
  Genbank Accession No. U49352
gagactagttctctctctctctcgtgccgaattcgcggaatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtggttatgcttcttgggttaatggagcagtcattaaatttgacggtggaggggaagtacttatttcaggggaaggcaacgacctgagaaaggtcaccaaggagcagtgggacacgatagaagaactcatcaggaagacaaaaggttcctaagaccactttggccttcatcttggttacagaaaagggaatagaaatgaaacaaattatctctcatcttttgactatttcaagtctaataaattcttaattaac

SEQ ID NO: 3375 - DNA, 666 bp, Homo sapiens
  Genbank Accession No. U49785
gatcccggtgccagggaccctgcccagttccaggcgtcgcctaacccagaaacgactgggcgccgcgtcctggaaaggccccagcgcacggacatctgaggagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgcggaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaa

SEQ ID NO: 3376 - DNA, 1809 bp, Homo sapiens
  Genbank Accession No. U50196
cgccttccctccaatcagcaccggggccggctagccaggggccggccgcgcggggtgtgtgaggacgcgctcccagtcgctgagtgcctgagccgggaagcagttgctgtggtacctgcgctgcccgagcggacgtagagcatcggacgcgggcgccgtggcgttgggcaggaggcgaagccaatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttcacgtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgacaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaacatgtaataaactttggataattaaaaaaaaaaaa

SEQ ID NO: 3377 - DNA, 2056 bp, Homo sapiens
  Genbank Accession No. U50527
cgtgacttcagtaawgggaacccggggctctcgcagccagccctcctgcccatggaggacagtttccttcaatcttttgggaggctgagcccagccccagcagcagcagcagcgkcagsgccgccccggcgcccccgcgggggacacctcctcgccgccacagctttaggaaacacctctacctcctgcgaggcctyccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggyatatcccccattattattgataataccaacctccacgcctgggaaatgaagccctatgcagtcatggtatttcagaccgaacaaaagaatcttttcaggctggaaatggacatggtagttttcaggccagaaatgaagaaacattcatggtgtctcaagagaaaaaatccaccgaatgaaagaacggtatgaacacgatgttacttttcacagtgtgcttcatgcagaaaagcggagcagaatgaacagaaaccaggacaggaataatgcattgccttccaacaatgccagatactggaattcctacacagagcttccaaaccgtaggcccacggtggatttacaaatgagagctcctatcacagaaggggcggttgtcaccatggatattagaggcctatcttacagccaggcagaattttcctaagtcagtttctacttcagtttttgttattttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttagctctgaagtgatctatttattttttcaggaaattcatctccatcggtaaagttgggaaggtggagagaagtggtgggggggcattgctacttatcaaagtgccattgctactttgataatctatgtatctaaaaatgtgwgatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattcggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgscttttatgttattaaaaattgtaaatggtatcacatttatatggatttgtcattggatctttttttggttcaacaataaaaaaatttaattaccaaaaaaaaaaaaaaaaaaaaaa

SEQ ID NO: 3378 - DNA, 860 bp, Homo sapiens
  Genbank Accession No. U50648
gactctcactgtcattgcagaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaagtgatgtacaacc

SEQ ID NO: 3379 - DNA, 2436 bp, Homo sapiens
  Genbank Accession No. U50929
cgaccacctgtctggacaccacaaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacaggggcaactatgtcttagagaagatatctgggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagagtattttgaacacgttgaagaagctgtgtgggcagttgaaaccttgatagcatccggtaaacctgtggcagcaaccatgtgcattggcccagaaggagatttgcatggcgtgccccccggcgagtgtgcagtgcgcctggtgaaagcaggagcatccatcattggtgtgaactgccactttgaccccaccattagtttaaaaacagtgaagctcatgaaggagggcttggaggctgcccaactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgcagcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataaaaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaaagaagagcaatgagaaaaaaaaaaaaaaaaaaaaa

SEQ ID NO: 3380 - DNA, 2808 bp, Homo sapiens
  Genbank Accession No. U51010
cgacggcccgggctggtactattcagtcataaagaagaattagatcctgtcatttgcaataacatggatggaactggaggtcataatgttgagtgaaataaaccaggcacagaaagacaaactttgcatgttctcacttatttatgggagctaaaaactaaaataactgaactcacagagatagagagtagaaggatggttacgagaggatgggaagggtagcgaggtgggtaggggggatgtggggatcattaatgggtataaaaaatagttagaggccaggcgcagtggctcacgcctgtaatcccagcactttgggaggccgaggtgggcggaacacctgaggagttcaagaccagcctggccaatatgatgaaaccccgtctctactaaaaatacaaaaattagttgggcgtgatggtgtgcacctgtagtcccagctgcttggggggctgaggcaggagaatcgctggaacccaagaggtgaaggttgcagtgagctgagatcgcgtcactgcactccagcctgggtgacagagtgagactccacatcaaaaaaaaaaaaagttagaaagattgaataagacctaatatttgctagcacaacagggtgaatatagtaaaaaataatttatttgtaccttcaaaaataactagacaagtataattgggttgtttgtaacacacaaaaaataagtgcttgaagtggtggataccccatttaccctgatgtgattattttgtattgcaggcctctatcagaatatctcatgtaacccataaatatatacacctactctgtacccacaaaaagtttttaaaaagaaaaataaatagcaaccgaaaaaaaaagagagggagaaaagaaaaaagaaaaaaaatcaagtgcctggctgggtagaataaattctaaggccacaatgttactgaccatgggttttttggctctcagtgtatagaaattgacacaaggccaatagtcttcccaaacatgctttactggaacttacgccctggcataagggccacaacaaaagagagagcgaattctctggcttgctgactccttggaaaaaaccggtagggatttttttattagacaaagcacaggaattgacgtcagaggcaggatgtgctgctgggcaaagcatacgagaagtggggtatgcaggtcagcattacttggttgcaatggttatcttgaggaatgggccaactggtggtcttggccagtggcaacaaggctgtaaatcaattattcagcattccttcccaaggtgggacactcggcaacattgtttatctcctaaggccagttcctggaattaagtgaaaggatgactaatggacatgttgtcagtgaggtagtggtgtgggttttgtgaccagtgggaatgcacgaaagaatgctttagcggggagtgagctgaagccaagccccatccctactctgtctcaaagtgagttcagaaaaggggatttaaagaattcttttttttttttttttgagacagagtcttgctctgtcgcccaggctggagtgcagtggcgccatcttggctcactgcaagctccgccccccgggttcatgccattctcctgcctcagcctcccaagtagctgggactgcaggtgcctaccaccaagcccagctaattttttgtattttttttttagtagagacggggtttcaccatgttagccaggatggtctcgatctcctgacctcgtgatctgcccgccttagccttcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaaagctgcagttgcctagggcagggatggagagagagtctgggcatgaggaagagggtctcgggatgtttggctggactagattttacagaaagccttatctaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaaactctggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagtctgagactcaggaagacaacttctgcagggtcactccctggcttctggaggaaaaaaaaggagggcactgctccagtggtacagaattgagacataatggaatcaggcttcacctccaaggacacctatctaagccattttaaccctcgggattacctagaaaaaatattacaagtttggttctaggcactctgcaaaaggccaaattcttaagcaccttctgaaaaatcttttcaaaatattctgcctaggtaagtctgttgtctgcatgtctcccca

SEQ ID NO: 3381 - DNA, 1699 bp, Homo sapiens
  Genbank Accession No. U51095
aggtgagcggttgctcgtcgtcggggcggccggcagcggcggctccagggcccagcatgcgcgggggaccccgcggccaccatgtatgtgggctatgtgctggacaaggattcgcccgtgtaccccggcccagccaggccagccagcctcggcctgggcccggcaaactacggccccccggccccgcccccggcgcccccgcagtaccccgacttctccagctactctcacgtggagccggcccccgcgcccccgacggcctggggggcgcccttccctgcgcccaaggacgactgggccgccgcctacggcccgggccccgcggcccctgccgccagcccagcttcgctggcattcgggccccctccagactttagcccggtgccggcgccccctgggcccggcccgggcctcctggcgcagcccctcgggggcccgggcacaccgtcctcgcccggagcgcagaggccgacgccctacgagtggatgcggcgcagcgtggcggccggaggcggcggtggcagcggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatagccccatgcccagcctgtgcgccgggggacctggggactcgggtgctgggagtgtggctcctgtgggcccaggaggtctggtccgagtctcagccctgaccttctgggacatggtggacagtcacctatccaccctctgcatccccttggcccattgtgtgcagtaagcctgttggataaagaccttccagctcctgtgttctagacctctgggggataagggagtccagggtggatgatctcaatctcccgtgggcatctcaagccccaaatggttgggggaggggcctagacaaggctccaggccccacctcctcctccatacgttcagaggtgcagctggaggcctgtgtggggaccacactgatcctggagaaaagggatggagctgaaaaagatggaatgcttgcagagcatgacctgaggagggaggaacgtggtcaactcacacctgcctcttctgcagcctcacctctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcacagctggacaggtgttgtatatagagtggaatctcttggatgcagcttcaagaataaatttttcttctcttttcaaa

SEQ ID NO: 3382 - DNA, 3062 bp, Homo sapiens
  Genbank Accession No. U51333
gacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttaagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgctgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggggaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacaaaaaaaaaaaaa

SEQ ID NO: 3383 - DNA, 3490 bp, Homo sapiens
  Genbank Accession No. U51477
gcggcgcggagcgggcgtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttctttaaaaaaaa

SEQ ID NO: 3384 - DNA, 1367 bp, Homo sapiens
  Genbank Accession No. U51478
agctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 3385 - DNA, 1791 bp, Homo sapiens
  Genbank Accession No. U51586
gcacgagcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagggggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaaaaaaactcgag

SEQ ID NO: 3386 - DNA, 5767 bp, Homo sapiens
  Genbank Accession No. U51903
gagggaggagagttcacttttacttcagtgtcagcgcgcggcggccgtggctggctctggcgagagagcaccgagggagtgggtcgcagatcttcgggcggctaggggaaatcggcgagaggcgggatccgagcgcgccggcggggcgcagagcccgcgagcctggccagcgagggtagccgcggggggcgcgccccgggcgggcccccggagacgcgcaggatgccacacgaagagctgccgtcgctgcagagaccccgctatggctctattgtggacgatgaaaggctctctgcagaggagatggatgagaggaggcggcagaacattgcttatgaatatctgtgccacttagaggaagccaaaaggtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataagaagtctggccttcattttcgacacacagataataccgtccagtggttaagagcgatggagtctattggtctacccaagatattttatccagaaacaacagatgtctatgatcggaaaaacataccaagaatgatatattgcattcacgcactgagtttgtatctgttcaaactaggaatagcaccccagatccaggatttgttgggcaaagtagacttcacagaggaggaaatcagtaatatgagaaaagaacttgagaaatatggaatacagatgccatctttcagcaaaataggtggtattctggccaatgaactgtccgtggatgaagctgcattacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaagaatagctgtatttcagaagaagaaagagatgcttatgaagaactgctgacacaagcagaaatccaaggcaatattaataaagtcaacaggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatgaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacgttatgcaaacacactactctctgttaaactagaagttttatcccaagggcaagataacttaagctggaatgaaattcagaattgtattgatatggttaatgctcaaattcaagaagaaaatgaccgagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgaggccaacgtggacgaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttctataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctgttgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaatgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaagttttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattccatt

SEQ ID NO: 3387 - DNA, 1652 bp, Homo sapiens
  Genbank Accession No. U53003
tcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgttag

SEQ ID NO: 3388 - DNA, 2885 bp, Homo sapiens
  Genbank Accession No. U53347
cggcacgcccgggaggctttctctggctggtaaccgctactcccggacaccagaccaccgccttccgtacacaggggcccgcatcccaccctcccggacctaagagcctgggtcccctgtttccggagtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagccaccgccaacgggggcctggcagctggcctccatcgaggaccaaggcgcggcagcaggcggctactgcggttcccgggacctggtgcgccgctgccttcgagccaacctgcttgtgctgctgacagtggtggccgtggtggccggcgtggcgctgggactgggggtgtcgggggccgggggtgcgctggcgttgggcccgggagcgcttgaggccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattatgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactattaaaaaaaaaaaaaaaaaa

SEQ ID NO: 3389 - DNA, 6457 bp, Homo sapiens
  Genbank Accession No. U53786
gctgaccagccagtgaggacgcccgctgcctcccacctgccctcctgccgtctttcgccagccaagcccagcctgagccagcacttgcctttacgaccatgttcaaggggctgagcaaaggctcccaggggaaggggtcccccaagggctcccccgccaaggggtcccccaaaggctcccccagcaggcacagccgggctgccacccaggagctggcccttctcatctcccgcatgcaagccaacgccgaccaggtggagcgggacatcctggagacgcagaagaggctgcagcaggaccggctgaacagtgagcagagccaggccctgcagcaccagcaggagacgggccgcagcctgaaggaggctgaggtgctgctcaaggacctcttcctggacgtggacaaggcccggcggctcaagcacccgcaggctgaggagattgagaaggacatcaagcagctgcacgagcgggtgacccaggagtgtgcggagtaccgtgccctgtacgagaagatggtgctgccccccgacgtgggacccagggtcgactgggcacgcgtgctggagcagaaacagaagcaggtctgcgcaggccagtacgggccgggcatggcggagctggagcaacagatcgccgagcacaacatcctgcagaaggagatcgacgcctatgggcagcagctgcggagcctcgtggggccggatgcagccaccatccggagccaataccgagacctactgaaggcggcgtcgtggcgcgggcagagcctgggcagcctgtacacgcacctccagggctgcacgcggcagctgagcgccctggctgagcagcagcgccgcatcctgcagcaggactggagcgacctcatggccgaccctgcgggcgtgcggcgggagtacgagcacttcaagcagcacgagctgctgagccaggagcagagcgtgaaccagctggaggacgacggcgagcgcatggtggagctgcggcaccccgcggtggggcccatccaggcccaccaggaggccctgaagatggagtggcagaacttcctgaacctgtgtatctgccaggagacccagctgcagcacgtggaggactaccgccggttccaggaagaggccgactcagtcagccagaccctggcgaagctcaactccaacttggatgccaagtacagccctgcacctgggggcccccctggcgcccccacagagctgctgcaacagctggaggcagaggaaaaacggctggccgtcaccgagagggccactggggacctgcagcggcgaagccgggatgtggcccctctgccacagcgaagaaacccccctcagcagcccctgcacgtggacagcatctgcgactgggactcaggagaagtgcagctgctgcagggtgagcggtataagctggtagataacactgaaccgcacgcctgggtcgtgcagggccctggcggggagaccaagcgtgctcccgccgcctgcttctgcatcccagcaccagaccctgatgctgtggccagggcctcccggctggcctcagagctgcaggccctgaagcagaaattggccacagtccagagccgcctgaaggccagtgctgtggagtctcttcggcccagccagcaggctccatctggctcagacctggccaacccacaggcccagaagctcctgacacagatgacccggctggatggagacctgggacagatagagaggcaggtgctggcctgggcgcgggccccgctgagccgccccacacccttggaggacttggagggccgcatccacagccatgagggcacagcccagcgcctgcagagcctgggaacggagaaggagacagcccagaaggagtgcgaggcgtttctgtccacgcggcccgtgggccccgctgccctgcagctgcccgtagccctcaacagcgtgaagaacaagttcagtgacgtgcaggttctgtgcagcctctacggggagaaagccaaggctgccctggatctggagcggcagatccaggatgcggacagggtcatccgaggcttcgaggccaccctggtgcaggaggcccccatccctgctgaaccgggggctctgcaggagagggtcagcgagctgcagcgccagcggagggagctgctggaacagcagacctgcgtgctgcggctacaccgcgcgctgaaggcctcggagcacgcatgcgctgccctgcagaacaacttccaggagttctgccaagacctgcctcgccagcagcgccaggtgcgagccctcaccgaccgctaccacgccgtaggggaccagctggacctgcgggagaaggtggtgcaggatgccgccctcacctaccagcagttcaagaactgcaaggataacctgagctcctggctggagcacctgccccgcagccaggtgcggcccagcgacggccccagccagatcgcctacaagctgcaggcgcagaagaggctgacgcaggagatccagagccgagagcgggacagggccacagcatcccacctctcccaggccctgcaggcagcgctccaggactatgagctccaggcagacacctaccgctgctctttggagcccaccctggcagtgtcagcccccaagagaccccgagtggctcccctgcaagagagcatccaagcccaggagaagaaccttgcaaaggcctatactgaggttgcagcagcacagcagcagctgctccagcagctggagtttgctagaaaaatgctggagaagaaggagctcagtgaggacatccgaaggacccatgatgcaaagcagggctccgagagccctgcccaagcagggagagagtcagaggccctgaaggcccagctggaagaggagaggaagcgggtggcccgggtgcagcatgagctggaggcgcagaggagccaactgctgcagctgaggacccagcggcccttggagaggctggaggagaaggaagtggtagagttctaccgggacccccagctggagggcagcctgtccagggtgaaggcccaggtggaggaggagggcaagcggcgggctggcctgcaggcagacctggaagtggcagcccagaaggtcgtgcagctggaaagcaagaggaagaccatgcagcctcatctgctgaccaaggaggtcacccaggtggagagggaccccggcctggacagccaggcggcccagctcaggatccagatccagcagctccgcggggaggatgccgtcatctcggcccggctggaagggctgaagaaggagctactggcccttgagaagagggaggtggacgtgaaggagaaggtcgtggtgaaagaggtagtcaaggtggagaagaatctggaaatggtcaaggcagcccaggctctgaggctgcagatggaggaggatgctgcgcggaggaagcaggcggaggaggctgtggccaagctacaggctcgcatcgaagacctggagcgggctatcagctcggtggagcccaaggtcatcgtgaaggaggtgaagaaggtggagcaggacccagggctcctccaggagtcctccaggctgaggagcctcctcgaggaggagaggaccaagaacgcgacgctggccagggagctgagcgacctgcacagcaagtacagcgtggtggagaagcagaggcccaaagtgcagctccaggagcgcgtccacgagatcttccaggtggatccggagacagagcaggagatcactcggctcaaggccaagctgcaggagatggcgggcaagaggagcggtgtggagaaggaggtggagaagctgctgcccgacctggaggtcctgcgggcccagaagcccacggtggagtacaaggaggtgacccaggaggtggtgaggcatgagaggagccccgaggtgctgcgtgagatcgaccgcctgaaggctcagctcaacgagctcgtcaacagccacgggcgctcccaggagcagctcatccgcctgcagggtgagcgcgacgagtggaggcgcgagcgggccaaggtggagaccaagacggtgagcaaggaggtggtgcgccacgagaaggacccggtgctggagaaagaagcagagcggctccgccaggaggtgcgggaggcggcccagaagaggcgggccgcggaggacgcggtgtacgagctgcagagcaagcgcctgctgctggagaggaggaagcccgaggagaaggtggtggtgcaggaggtggtggtcacccagaaggacccgaagctgcgcgaggagcacagccggctgagcgggagcctggatgaggaggtgggccggcggcgccagctagagcttgaggtgcagcagctgcgggccggcgtggaggagcaggagggcctgctcagcttccaggaggaccgcagcaagaagctggccgtggagagggagctgcggcagctgaccttgaggatccaggagctcgagaagcggcctcccacggtgcaggagaagatcatcatggaggaagtggtcaagctggagaaggacccggacctggagaagtccacggaagccctgcggtgggacctggaccaggagaagacccaggtaaccgagctgaatcgggagtgcaagaacctgcaggtccagattgacgtcctccagaaagccaaatcgcaggagaagaccatctacaaggaagtgatccgggtgcagaaggaccgcgtcctggaagatgagcgggcccgcgtgtgggagatgctcaacagggagcgcacggcccggcaggcccgggaggaggaggcacggcgcctgcgggagcgcattgaccgggccgagacgctggggagaacctggtcccgggaggagtccgagctgcagagggcccgggaccaggccgaccaggagtgtgggcggctgcagcaggagctgcgggctctggagaggcagaagcagcagcagacactgcagctgcaggaggagtcgaagctgctcagccagaagacggagagcgagcgacagaaggcggcccagcggggccaggagctctcgcggctggaggcggccatcctccgcgagaaggaccagatctacgagaaggagcggacgctccgggacctccacgccaaggtgagccgggaggagctcagccaggagacccagacgcgagagaccaacctttccaccaagatctccatcctggaacccgagacggggaaggacatgtccccatacgaggcctacaagaggggcatcatcgacaggggccagtacttgcagctgcaggagctcgagtgtgactgggaggaggtcaccacctcggggccctgtggggaggagtctgtgctcctggaccgcaagagcgggaagcagtactccatcgaggccgccctccgctgccggcgcatctctaaggaggagtaccatctgtacaaggacggccacctgcccatctccgagtttgcgctgcttgtagctggggagaccaagccaagctcctcactctccatcggctctatcatctccaagtccccgctcgcctccccggccccccagagcaccagtttcttctctcccagcttctctctcgggctcggtgatgacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccaggtaggatacgtacacctcttgcctcagagcagcctcatcccaggcagtgggtcttccctctgtccaaccactgttttattattttactaacatggtgatgggctccctcccctaaccttggtgcctgatccatccccagaccaggacagcagccactcagttcttcctccacctccacccagtgatcccaataaacgaattctgtctccccgtg

SEQ ID NO: 3390 - DNA, 1890 bp, Homo sapiens
  Genbank Accession No. U53830
ggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcttggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccag

SEQ ID NO: 3391 - DNA, 1280 bp, Homo sapiens
  Genbank Accession No. U55206
tgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattatgtatgtgactatttatataacattagataattaaatagtgagacataaatagagtgctttttcatggaaaagccttcttatatctgaagattgaaaaataaatttactgaaatacaaaaaaaaaaaaaaa

SEQ ID NO: 3392 - DNA, 1023 bp, Homo sapiens
  Genbank Accession No. U56814
tcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagaaaaaaaaaaaaaaaaaaaaaaa

SEQ ID NO: 3393 - DNA, 1061 bp, Homo sapiens
  Genbank Accession No. U57094
agacaaaaagtaaccttcctgaagaggacatgtgattggaagttgtcaattgttgaagcattggtaactccagtctctaacgttttagaaaatcataacaagcggttctgtaccctgtaaagaacagaaacctggaaatctaaggctcaaagacatccaagtaattggtatctgggagatttgggattcaaacccagctctgcttgacttggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcaggccaaaaagagtggtgtacagagccagtgggccggatggaccagtaggtagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaacgacatagtagttcaggtggcccatgcctgggatcttctctatgattgatacatggcacagtgagagattaatgggcattgtgtacaaattgcttctcaccatccccattagacctacgaataaagcatccggttctaaaattaaaaaaa

SEQ ID NO: 3394 - DNA, 1637 bp, Homo sapiens
  Genbank Accession No. U57721
aagaactggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttac

SEQ ID NO: 3395 - DNA, 361 bp, Homo sapiens
  Genbank Accession No. U58682
cgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctccctcttggatgtcgggttcgaccacttggccgatgggaatggtctgtcacaatctgctccttttttttgtccgccacacgtaactgagatgctcctttaaataaagcgtttgtgtttcaagtt

SEQ ID NO: 3396 - DNA, 1515 bp, Homo sapiens
  Genbank Accession No. U59111
ttttttttttttttcatcaggtcagagccaaaggaaagcttgaaaaatgaagacattagcaggacttgttctgggacttgtcatcttggatgctgctgtgactgccccaactctagagtccatcaactatgactcagaaacctatgatgccaccttagaagacctggataatttgtacaactatgaaaacatacctgttgataaagttgagattgaaatagccacagtaatgccttcagggaacagagagctcctcactccacccccacagcctgagaaggcccaggaagaggaagaggaggaggaatctactcccaggctgattgatggctcttctccccaggagcctgaattcacaggggttctggggccacacacaaatgaagactttccaacctgtctttggtgtacttgtataagtaccaccgtgtactgtgatgaccatgaacttgatgctattcctccgctgccaaagaacaccgcttatttctattcccgctttaacagaattaaaaagatcaacaaaaatgactttgcaagcctaagtgatttaaaaaggattgatctgacatcaaatttaatatctgagattgatgaagatgcattccgaaaactgcctcaacttcgagagcttgtcctgcgtgacaacaaaataaggcagctcccagaattgccaaccacttcgacatttattgatattagcaacaatagacttggaaggaaagggataaagcaagaagcatttaaagacatgtatgatctccatcatctgtacctcactgataacaacttggaccacatccctctgccactcccagaaaatctacgagcccttcacctccagaataacaacattctggaaatgcacgaagatacgttctgcaatggtaaaaatttgacttatattcgtaaggcactagaggacattcgattggatggaaaccctattaatctcagcaaaactccacaagcatacatgtgtctacctcgtctgcctgttgggagccttgtctaatttcagataatggttagcattacgatggctactataaataaaccattcttactgctctcttccaaaacaaaactcagcatgatactttgagattgtgttctgagagatgatatgactacataaaatacaattaaaaatgttataatataatgaaaatgtagtaatttaagaaaacaccagatgagttaggaataaacctataacatttacaaaaagagcaaaactaagtgatagaaaatatttcacacatgttcttatagatcatgtatcacttgcaagttttaggagttcatatcctatatcatttcaaattaagtacataataaagtaaaattttgaaatgaacactttaggtatttttgccaagatttagatgtttttaattaaacttttctcttcctttttttttcactaaggcatgtttattcccctaatccattaaagagcatgaaaaaaagaataaatgtatttgaaaaaaaaaaaaaaaaaaaaaaaaaaaa

SEQ ID NO: 3397 - DNA, 2010 bp, Homo sapiens
  Genbank Accession No. U59321
atgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcacgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccaggagctaccaatatgataggttacatggggcagactgcctaccaataccctcctcctcctccccctcctcctccttcacgtaaatgaaaccactcaagtggtagtgactccagcagacttaattacattttaaggaacactgtc

SEQ ID NO: 3398 - DNA, 1990 bp, Homo sapiens
  Genbank Accession No. U59423
gaattccgggggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcaccgcccggccgtccggacccgggccgcgagaccccgctcgcccggccactcgtgctcccgcacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccagcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaaa

SEQ ID NO: 3399 - DNA, 1404 bp, Homo sapiens
  Genbank Accession No. U60061
ctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagtaagttttgattttcaaatgttctgcttcatgtgtctgtgaagaattgtacttttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagtaaaaaaaaaaaaaaaaaaattccctgcggccgc

SEQ ID NO: 3400 - DNA, 1751 bp, Homo sapiens
  Genbank Accession No. U60205
gcgagatgactgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttgtctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttctcgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaa

SEQ ID NO: 3401 - DNA, 464 bp, Homo sapiens
  Genbank Accession No. U62389
  unsure (1)..(464): n = a or c or g or t
acgaaatattctgggtggcacggtcttcanagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgaca

SEQ ID NO: 3402 - DNA, 1574 bp, Homo sapiens
  Genbank Accession No. U62392
ctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcactttacctctttcttactcttactagctgtgtccctcttatttataatttatttatttttttgagatggctgctaaacccttctaataatataataaatggcactg

SEQ ID NO: 3403 - DNA, 1510 bp, Homo sapiens
  Genbank Accession No. U62962
ggactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcattttaaaaaaaaa

SEQ ID NO: 3404 - DNA, 1683 bp, Homo sapiens
  Genbank Accession No. U65932
ctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatg

SEQ ID NO: 3405 - DNA, 3154 bp, Homo sapiens
  Genbank Accession No. U66661
cgcgacctccgcgcaggtggtcgcgccggtctccgcggaaatgttgtccaaagttcttccagtcctcctaggcatcttattgatcctccagtcgagggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatcgccgtcaacagccttggtcctctctctatcctagacatggaatacaccattgacatcatcttctcccagacctggtacgacgaacgcctctgttacaacgacacctttgagtctcttgttctgaatggcaatgtggtgagccagctatggatcccggacaccttttttaggaattctaagaggacccacgagcatgagatcaccatgcccaaccagatggtccgcatctacaaggatggcaaggtgttgtacacaattaggatgaccattgatgccggatgctcactccacatgctcagatttccaatggattctcactcttgccctctatctttctctagcttttcctatcctgagaatgagatgatctacaagtgggaaaatttcaagcttgaaatcaatgagaagaactcctggaagctcttccagtttgattttacaggagtgagcaacaaaactgaaataatcacaaccccagttggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagcaaaaagaaaaaaaaaaa

SEQ ID NO: 3406 - DNA, 1346 bp, Homo sapiens
  Genbank Accession No. U66672
  unsure (1)..(1337): n = a or c or g or t
cagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagagagtggcaactaaatacatctctttctgtgtgaaaaaaggagagatcttaggactattgggtccaaatggtgctggcaaaagcacaattattaatattctggttagtgatattgaaccagcttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcnaggaatcaaacgaaagtgtgttttgctctaagtatgctagggaatcctcagattactttgctagatgaaccatctacaggtctggatcccaaatgccaaacatgcacatgtggcatgcaattcgaactgcatnnaagcgggctgctattctgaccactcactatatggaggaggcagaggctgtctgtgatcgagtagctatcatggtgtctgggcagttaagatgtatcggaacagtacaacatctaaagagtaaatttggaaaagnactttttggaaattaaattgaacggactggatagaaaacctagaagctagaccgccttcaaagagaaattcagtatattttcccaaatgcaagccgtcagaaagtttttcttctattttggcttctaaaattaataaggaagatgttcagtccctttcccaatctttttttaagctggaagaagctaaacatgctttgccattgaagaatatagctttctcaagcaacattggaacaggtttttgtagaactcactaaagaacaagaggaggaagataatagttgtggaactttaaacagcacactttggtggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaaaaaaaaa

SEQ ID NO: 3407 - DNA, 1977 bp, Homo sapiens
  Genbank Accession No. U66674
  unsure (1)..(1968): n = a or c or g or t
ttgcaccaggcactgctgcacaacaagatacgctcgccacagtccttctttgacaccacaccatcaggccgcatcctgaactgcttctccaaggacatctatgtcgccttgatgaggttctggcccctgtcaccntcancgccgctcaattacttcttcaacgccatctccactcttgtggtcatcatggccagcacgacggatcttnacttgtgggtnanntgcccctgggtngtgctcttacaccttagtgcagcgcttctatgcagccacatcacggcaactgaagcggctggaatcagtcagccgtcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaacagccgccctcccgaaggttggccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcagctgggagcttccagtgctcagagggcggggagaatctcagcgtggnccagaggagctcgtgtgccatggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactagcatggactacaccagggtcctggtcctggacaaaggagtagtagctgagtttgattctccagccaacctcattgcagctagaggcatcttctacgggatggccagagatgctggacttgcctaaaatatatctgagatttcctcctggcctttcctggttttcatcaggaaggaaatgacaccaaatatgtccgcagaatggacttgatagcaaacactgggggcaccttaagatttttgcacctgtaaagtgccttacagggtaactgtgctgaatgctttagatgaggaaaagatccccaagtggtgaatgacacgcctaaggtcacagctagtttgagccagttagactagtcccgggtctcccgaatcccaactgagtgttatttgcacactgcactgttttcaaataacgattttatgaaatgacctctgtcctccctctgatttttcatattttctaaagtttcgtttctgttttttaataaaaagctttttccccctggaacagaagacagctgctgggtcaggccacccctaggaactcagtcctgtactctggggtgctgcctgaatccattaaaaatgggagtactgatgaaataaaactacatggtcaacagtaaaaaaaaaaaaaaaaaaaa

SEQ ID NO: 3408 - DNA, 758 bp, Homo sapiens
  Genbank Accession No. U67171
caggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaaattaaccggaaaaaaaaaaaaaaaaaaa

SEQ ID NO: 3409 - DNA, 1192 bp, Homo sapiens
  Genbank Accession No. U67963
ccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgcaaaaaaaaaaaaaaaaaaa

SEQ ID NO: 3410 - DNA, 1959 bp, Homo sapiens
  Genbank Accession No. U68142
ggacattctcacctctgcccatctgtccgagctactgtcacacagtttaacaaggtggcaggggcagtggttagttctatcctgggggctacttggagtggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccgtccctgcacagtccaggtgaacccagccacctctccccaccagcctcctcccctaggccttctcgaggtcaccgccgctcagcctcctgtggctccccgctgagtgggggtgcagaagaggcctccggggggactggatatcgggggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcacggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaaaaaaaaaaaaaaaa

SEQ ID NO: 3411 - DNA, 2218 bp, Homo sapiens
  Genbank Accession No. U68233
acgagactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaacagaaaaaaaaaaaaaaaaaaaaaaaaaaaaaaaaaaaaaaaaaaaaaaaaaaaaaaaaaaaaaaaaaaaaaa

SEQ ID NO: 3412 - DNA, 1843 bp, Homo sapiens
  Genbank Accession No. U68494
ggcacgagcaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatctaaaaaaaa

SEQ ID NO: 3413 - DNA, 1798 bp, Homo sapiens
  Genbank Accession No. U69141
cggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcagatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctgaaaaaaaaaaaaaaaaaa

SEQ ID NO: 3414 - DNA, 3136 bp, Homo sapiens
  Genbank Accession No. U70732
  unsure (1)..(3136): n = a or c or g or t
ccccgccttcacccactgcctctgcctccctggggcagagctgtttcccagacgggtggggcggggcccaactgtcccagctccttcagccctttctgtccctcccagtgaggccagctgcggtgaagagggtgctctcttgcctggcgttccctctgcacggctgccccctcccaccctgcccactaagccagacccactgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccaggtatggcccagggcccctcgctgccctccaggtcacaatggggtggccgagttggccccagccccactggcacatgggacaagggctgaggggttaggtagggcacagtctccctgcctgcacccctcccagggtgtgaagaagcctttcaccgaggtcatccgtgccaacatcggggacgcacaggctatggggcagaggcccatcaccttcctgcgccaggtgaggcttctctgcactccctcccggagcacccccccacccccagcccatgtaccctggcctcagcactccgtctctcaggtcttggccctctgtgttaaccctgatcttctgagcagccccaacttccctgacgatgccaagaaaagggcggagcgcatcttgcaggcgtgtgggggccacagtctgggtgagagagagccagggccagggccaggcggaagcagagggccgcccttgccactggaggagggaagtcccttgggagggctgaggagaacttcacctgtaccttcccaatcctttcctgcccgactccaggggcctacagcgtcagctccggcatccagctgatccgggaggacgtggcgcggtacattgagaggcgtgacggaggcatccctgcggaccccaacaacgtcttcctgtccacaggggccagcgatgccatcgtggtaggctgggcatgggcaccaagacattcctgacactgcagagggggcgcccagggtgggggacaggtgcggccccaggccctcgccaaccctgccttccccttcctttccgcagacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccggtgcgttccccgccgccccgcccaattccccccgcgccaacgttgcgttccccgccgccccgcccaattccccccgcgcccacggtgcgttccccgccgccccgcccaactccccccgcgcccacggtgcgttccccgccgccccgccccactccccccgcgcccacggtgcgttccccgccgccccgccccactccctccgcgcccacggtgcgttccccgccgccccgccccactcctccccacccaacgtgcgccctggcccggcnngccggtccgctggaccccgctgcccagcggagggcagtgcgcccccttggctcacccagcactgctgcctccccggcaccccagggcaggtgcagacccgcgagtgcatcgaggccgtgatccgcttcgccttcgaagagcggctctttctgctggcggacgaggtcgcggcgggggagcggggagccgggcaacagtccgcccccgtgacgccttgcgccccttaccgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgtgcaacgaggcgggtgggggctcgcgggccatggccaggccctcctcgcccgatgggccaccccctcctccgcacctgacctggccgtgcgcaggtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgtgagttgggggcaggagggggtccaggtgacctaatcaggggtgggggatccgagtgccgtgccctgatgggccctccctccgcggccacaggagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggtcaggcgggggcggggcctgcggggtgggtaggggggtttgggtatccctctctgacggctctccgtccacaggagctgggcctggcccccgatatgttcttctgcctgcgcctcctggaggagaccggcatctgcgtggtgccagggagcggctttgggcagcgggaaggcacctaccacttccggtgaggcctggccctcactccctgtcccgccaccctggcccttcactcactgtcaactcctttcaggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctg

SEQ ID NO: 3415 - DNA, 1842 bp, Homo sapiens
  Genbank Accession No. U72515
tacctcatccacctcttccatacctttacaggcctctcaattgcttattttaactttggaaaccagctctaccactccctgctgtgtattgtgcttcagttcctcatccttcgactaatgggccgcaccatcactgccgtcctcactaccttttgcttccagatggcctaccttctggctggatactattacactgccaccggcaactacgatatcaagtggacaatgccacattgtgttctgactttgaagctgattggtttggctgttgactactttgacggagggaaagatcagaattccttgtcctctgagcaacagaaatatgccatacgtggtgttccttccctgctggaagttgctggtttctcctacttctatggggccttcttggtagggccccagttctcaatgaatcactacatgaagctggtgcagggagagctgattgacataccaggaaagataccaaacagcatcattcctgctctcaagcgcctgagtctgggccttttctacctagtgggctacacactgctcagcccccacatcacagaagactatctcctcactgaagactatgacaaccaccccttctggttccgctgcatgtacatgctgatctggggcaagtttgtgctgtacaaatatgtcacctgttggctggtcacagaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccgctacatcttcaaacgactcaagttccttggaaataaagaactctctcagggtctctcgttgctattcctggccctctggcacggcctgcactcaggatacctggtctgcttccagatggaattcctcattgttattgtggaaagacaggctgccaggctcattcaagagagccccaccctgagcaagctggccgccattactgtcctccagcccttctactatttggtgcaacagaccatccactggctcttcatgggttactccatgactgccttctgcctcttcacgtgggacaaatggcttaaggtgtataaatccatctatttccttggccacatcttcttcctgagcctactattcatattgccttatattcacaaagcaatggtgccaaggaaagagaagttaaagaagatggaataatccatttccctggtggcctgtgcgggactggtgcagaaactactcgtctcccttttcacagcactcctttgccccagagcagagaatggaaaagccagggaggtggaagatcgatgcttccagctgtgcctctgctgccagccaagtcttcatttggggccaaaggggaaacttttttttggagaaggcgtcttgctttgtcacccacgctggaatgcagtggcgggatctcagctcaccgcaacctccacctcctgggttcaagtgattttcctgcctcagcctcccaagtagctgggaatacaggcacgccaccatgcccagctaatttttgtattttcagtagaaacgggatttcaccacgttggccaggctggtctcgaactcctgaccgcaagtgatccacccgcctccgcctcccaaagtgctgggattacaggcgtgagccaccgtgcccggcccaaaggggaaactcttgtgggaggagcagaggggctcacatctcccctctgattcccccatgcacattgccttatctctccccatctagccaggaatctattgtgtttttcttctgcc

SEQ ID NO: 3416 - DNA, 3664 bp, Homo sapiens
  Genbank Accession No. U73377
atggggcctgaaactgtctgggtctgagctggggagcggaagccacttgtccctctccctccccaggacttctgtgactcctgggccacagaggtccaaccagggtaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgatggggcagccatgccagagtcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgggtgcctccacctccccagtcggtgtccatggctgagcagctccgaggggagccctggttccatgggaagctgagccggcgggaggctgaggcactgctgcagctcaatggggacttcttggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcttcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctgcgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgctagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctaaaaaaaaaaaaaaaaaaatacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcc

SEQ ID NO: 3417 - DNA, 783 bp, Homo sapiens
  Genbank Accession No. U73379
ggcacgagcgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttaaaaaaaaaaaaaaaaaaa

SEQ ID NO: 3418 - DNA, 947 bp, Homo sapiens
  Genbank Accession No. U73514
gtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtatccgggtgatgaccattgccccaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacagag

SEQ ID NO: 3419 - DNA, 2814 bp, Homo sapiens
  Genbank Accession No. U73682
gacaggccggggttactgtggcgaccacgagagcagctttggcgctatggaggagcccggggctacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttccagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaagggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataaaaaaaaaaaaaaaaaaaaaaaaaaaaaaaaaaaaaaaaaaaaaaaaaaaaaa

SEQ ID NO: 3420 - DNA, 1915 bp, Homo sapiens
  Genbank Accession No. U73843
ttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttct

SEQ ID NO: 3421 - DNA, 14796 bp, Homo sapiens
  Genbank Accession No. U75285
tctagacatgcggatatattcaagctgggcacagcacagcagccccaccccaggcagcttgaaatcagagctggggtccaaagggaccacaccccgagggactgtgtgggggtcggggcacacaggccactgcttccccccgtctttctcagccattcctgaagtcagcctcactctgcttctcagggatttcaaatgtgcagagactctggcacttttgtagaagccccttctggtcctaacttacacctggatgctgtggggctgcagctgctgctcgggctcgggaggatgctgggggcccggtgcccatgagcttttgaagctcctggaactcggttttgagggtgttcaggtccaggtggacacctgggctgtccttgtccatgcatttgatgacattgtgtgcagaagtgaaaaggagttaggccgggcatgctggcttatgcctgtaatcccagcactttgggaggctgaggcgggtggatcacgaggtcaggagttcaataccagcctggccaagatggtgaaaccccgtctctactaaaaatacaaaaaaattagccgggcatggtggcgggcgcatgtaatcccagctactgggggggctgaggcagagaattgctggaacccaggagatggaggttgcagtgagccaagattgtgccactgcactgcactccagcctggcgacagagcaagactctgtctcaaaaaaaaaaaaaaaaagtgaaaaggagttgttcctttcctccctcctgagggcaggcaactgctgcggttgccagtggaggtggtgcgtccttggtctgtgcctgggggccaccccagcagaggccatggtggtgccagggcccggttagcgagccaatcagcaggacccaggggcgacctgccaaagtcaactggatttgataactgcagcgaagttaagtttcctgattttgatgattgtgttgtggttgtgtaagagaatgaagtatttcggggtagtatggtaatgccttcaacttacaaacggttcaggtaaaccacccatatacatacatatacatgcatgtgatatatacacatacagggatgtgtgtgtgttcacatatatgaggggagagagactaggggagagaaagtaggttggggagagggagagagaaaggaaaacaggagacagagagagagcggggagtagagagagggaaggggtaagagagggagaggaggagagaaagggaggaagaagcagagagtgaatgttaaaggaaacaggcaaaacataaacagaaaatctgggtgaagggtatatgagtattctttgtactattcttgcaattatcttttatttaaattgacatcgggccgggcgcagtggctcacatctgtaatcccagcactttgggaggccgaggcaggcagatcacttgaggtcaggagtttgagaccagcctggcaaacatggtgaaaccccatctctactaaaaatacaaaaattagcctggtgtggtggtgcatgcctttaatctcagctactcgggaggctgaggcaggagaatcgcttgaacccgtggcggggaggaggttgcagtgagctgagatcatgccactgcactccagcctgggcgatagagcgagactcagtttcaaataaataaataaacatcaaaataaaaagttactgtattaaagaatgggggcggggtgggaggggtggggagaggttgcaaaaataaataaataaataaataaaccccaaaatgaaaaagacagtggaggcaccaggcctgcgtggggctggagggctaataaggccaggcctcttatctctggccatagaaccagagaagtgagtggatgtgatgcccagctccagaagtgactccagaacaccctgttccaaagcagaggacacactgattttttttttaataggctgcaggacttactgttggtgggacgccctgctttgcgaagggaaaggaggagtttgccctgagcacaggcccccaccctccactgggctttccccagctcccttgtcttcttatcacggtagtggcccagtccctggcccctgactccagaaggtggccctcctggaaacccaggtcgtgcagtcaacgatgtactcgccgggacagcgatgtctgctgcactccatccctcccctgttcatttgtccttcatgcccgtctggagtagatgctttttgcagaggtggcaccctgtaaagctctcctgtctgactttttttttttttttagactgagttttgctcttgttgcctaggctggagtgcaatggcacaatctcagctcactgcaccctctgcctcccgggttcaagcgattctcctgcctcagcctcccgagtagttgggattacaggcatgcaccaccacgcccagctaatttttgtatttttagtagagacaaggtttcaccgtgatggccaggctggtcttgaactccaggactcaagtgatgctcctgcctaggcctctcaaagtgttgggattacaggcgtgagccactgcacccggcctgcacgcgttctttgaaagcagtcgagggggcgctaggtgtgggcagggacgagctggcgcggcgtcgctgggtgcaccgcgaccacgggcagagccacgcggcgggaggactacaactcccggcacaccccgcgccgccccgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcgggtgagactgcccggcctcctggggtcccccacgcccgccttgccctgtccctagcgaggccactgtgactgggcctcgggggtacaagccgccctcccctccccgtcctgtccccagcgaggccactgtggctgggccccttgggtccaggccggcctcccctccctgctttgtccccatcgaggcctttgtggctgggcctcggggttccgggctgccacgtccactcacgagctgtgctgtcccttgcagatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttgaactgagttgtcaaaagatttgagttgcaaagacacttagtatgggagggttgctttccaccctcattgcttcttaaacagctgttgtgaacggatacctctctatatgctggtgccttggtgatgcttacaacctaattaaatctcatttgaccaaaatgccttggggtggacgtaagatgcctgatgcctttcatgttcaacagaatacatcagcagaccctgttgttgtgaactcccaggaatgtccaagtgctttttttgagattttttaaaaaacagtttaattgaaatataacctacacagcacaaaaattaccctttgaaagtgtgcacttcacactttcggaggctgaggcgggcggatcacctgaggtcaggagttcaagacctgcctggccaacttggcgaaaccccgtctctactaaaaatacaaaaattagccgggcatggtagcgcacgcccgtaatcccagctactcgggaggctaaggcaggagaatcgcttgaacctgggaggcggaggttgcagtgagccgagattgtgccaatgcactccagcctcggcgacagagcgagactccgtcataaaaataaaaaattgaaaaaaaaaaaagaaagaaagcatatacttcagtgttgttctggatttttttcttcaagatgcctagttaatgacaatgaaattctgtactcggatggtatctgtctttccacactgtaatgccatattcttttctcacctttttttctgtcggattcagttgcttccacagctttaatttttttcccctggagaatcaccccagttgtttttctttttggccagaagagagtagctgttttttttcttagtatgtttgctatggtggttatactgcatccccgtaatcactgggaaaagatcagtggtattcttcttgaaaatgaataagtgttatgatattttcagattagagttacaactggctgtctttttggactttgtgtggccatgttttcattgtaatgcagttctggtaacggtgatagtcagttatacagggagactcccctagcagaaaatgagagtgtgagctagggggtcccttggggaacccggggcaataatgcccttctctgcccttaatccttacagtgggccgggcacggtggcttacgcctgtaataccagcactttgggaggccgaggcgggcggatcacgaggtcaggagatcgagaccatcttggctaatacggtgaaaccccgtctccactaaaaatacaaaaaattagccgggcgtggtggtgggcgcctgtagtcccagctactcgggaggctgaggcaggagaatggcgtgaacccaggaggcggagcttgcagtgagccgagattgcaccactgcactccagcctgggcgacagaatgagactccgtctcaaaaaaaaaaaaaaaagaaaaaaatctttacagtggattacataacaattccagtgaaatgaaattacttcaaacagttccttgagaatgttggagggatttgacatgtaattcctttggacatataccatgtaacacttttccaactaattgctaaggaagtccagataaaatagatacattagccacacagatgtggggggagatgtccacagggagagagaaggtgctaagaggtgccatatgggaatgtggcttgggcaaagcactgatgccatcaacttcagacttgacgtcttactcctgaggcagagcagggtgtgcctgtggagggcgtggggaggtggcccgtggggagtggactgccgctttaatcccttcagctgcctttccgctgttgttttgatttttctagagaggaacataaaaagcattcgtccggttgcgctttcctttctgtcaagaagcagtttgaagaattaacccttggtgaatttttgaaactggacagagaaagagccaagaacaaaattgtatgtattgggaataagaactgctcaaaccctgttcaatgtctttagcactaaactacctagtccctcaaagggactctgtgttttcctcaggaagcattttttttttttttctgagatagagtttcactcttgttgcccaggctggagtgcaatggtgcaatcttggctcactgcaacctctgcctctcgggttcaagtgattctcctgcctcagcctcccaagtaactgggattacagggaagtgccaccacacccagctaatttttgtatttttagtagagatggggtttcaccacattgcccaggctggtcttgaactcctgacctcgtgattcgcccaccttggcctcccaaagtgctgggattacaggcgtgaaccaccacgcctggcttttttttttttgttctgagacacagtttcactctgttacccaggctggagtagggtggcctgatctcggatcactgcaacctccgcctcctgggctcaagtgatttgcctgcttcagcctcccaagtagccgagattacaggcatgtgccaccacacccaggtaatttttgtatttttggtagagacgaggtttcaccatgttggccaggctggttttgaactcctgacctcaggtgatccacccgcctcagcctcccaaagtgctgagattataggtgtgagccaccacacctggcctcaggaagtatttttatttttaaatttatttatttatttgagatggagtcttgctctgtcgcccaggctagagtgcagcgacgggatctcggctcactgcaagctccgccccccaggttcaagccattctcctgcctcagcctcccgagtagctgggactacaggcgcccgccaccacacccggctaatttttttgtatttttagtagagacgggttttcaccgtgttagccaggagggtcttgatctcctgacctcgtgatctgcctgcctcggcctcccaaagtgctgggattacaggtgtgagccaccacacccggctatttttatttttttgagacagggactcactctgtcacctgggctgcagtgcagtggtacaccatagctcactgcagcctcgaactcctgagctcaagtgatcctcccacctcatcctcacaagtaattgggactacaggtgcaccccaccatgcccacctaatttatttatttatttatttatttattttcatagagatgagggttccctgtgttgtccaggctggtcttgaactcctgagctcacgggatccttttgcctgggcctcccaaagtgctgagattacaggcatgagccaccgtgcccagctaggaatcatttttaaagcccctaggatgtctgtgtgattttaaagctcctggagtgtggccggtataagtatataccggtataagtaaatcccacattttgtgtcagtatttactagaaacttagtcatttatctgaagttgaaatgtaactgggctttatttatttatttatttatttatttatttttaatttttttttttgagacgagtctcactttgtcacccaggctggagtgcagtggcacgatctcggctcactgcaacctctgcctcccggggtcaagcgattctcctgccttagcctcccgagtagctgggactacaggcacgcaccaccatgcctggctaatttttgtatttttagtagacggggtttcaccatgctggccaagctggtctcaaactcctgaccttgtgatctgcccgctttagcctcccagagtgctgggattacaggcatgagccaccatgcgtggtctttttaaaattttttgattttttttttttttgagacagagccttgctctgtcgcccaggctggagtgcagtggcacgatctcagctcactacaagctccgcctcccgggttcacgccattcttctgcctcagcctcctgagtagctgggactacaggtgcccaccaccacgcctggctaattttttttggtatttttattagagacaaggtttcatcatgttggccaggctggtctcaaactcctgacctcaagtgatctgcctgcctcggcctcccaaagcgctgagattacaggtgtgatctactgcgccaggcctgggcgtcatatattcttatttgctaagtctggcagccccacacagaataagtactgggggattccatatccttgtagcaaagccctgggtggagagtcaggagatgttgtagttctgtctctgccacttgcagactttgagtttaagccagtcgtgctcatgctttccttgctaaatagaggttagaccccctatcccatggtttctcaggttgcttttcagcttgaaaattgtattcctttgtagagatcagcgtaaaataattctgtccttatatgtggctttattttaatttgagacagagtgtcactcagtcgcccaggctggagtgtggtggtgcgatcttggctcactgcgacctccacctcccaggttcaagcgattctcgtgcctcaggctcccaagtagctgagattataggtgtgtgccaccaggcccagctaacttttgtatttttagtagagacagggttttgccatgttggctaagctggtctcgaactcctggcctcaagtgatctgcccgccttggcatcccaaagtgctgggattacaggtgtgaaccaccacacctggcctcaatatagtggcttttaagtgctaaggactgagattgtgttttgtcaggaagaggccagttgtgggtgaagcatgctgtgagagagcttgtcacctggttgaggttgtgggagctgcagcgtgggaactggaaagtgggctggggatcatctttttccaggtcaggggtcagccagcttttctgcagcgtgccatagaccatctcttagccctcgtgggtcagagtctctgttgcatattgtcttttgttgtttttcacaaccttttagaaacataaaaagcattcttagcccgtgggctggacaaaaaaaggccatgacgggctgtatggatttggcccagcaggcccttgcttgccaagccctgttttagacaaggagcagcttgtgtgcctggaaccatcatgggcacaggggaggagcagagtggatgtggaggtgtgagctggaaaccaggtcccagagcgctgagaaagacagagggtttttgcccttgcaagtagagcaactgaaatctgacaccatccagttccagaaagccctgaagtgctggtggacgctgcggggtgctccgctctagggttacagggatgaagatgcagtctggtagggggagtccactcacctgttggaagatgtgattaagaaaagtagactttcagggccgggcatggtggctcacgcctgtaatcccagcactttgggaggccgaggcgggtggatcacgaggtcaggagatcgagaccatcctggctaacatggtgaaaccccgtctttactaaaaatacaaaaaattagctgggcgtggtggcgggcgcctgtagtcccagctactcgggaggctgaggcaggagaatggcgtgaacctgggaggtggagcttgctgtgagccgagatcgcgccactgcactccagcctgggcgacagagcgagactccgtctcaaaaaaaaaaaaaaaagtaggctttcatgatgtgtgagctgaaggcgcagtaggcagaagtagaggcctcagtccctgcaggagacccctcggtctctatctcctgatagtcagacccagccacactggaaagaggggagacattacagcctgcgagaaaagtagggagatttaaaaactgcttggcttttattttgaactgttttttttgtttgtttgttttccccaattcagaatacagaatacttttatggatttgtttttattactttaattttgaaacaatataatcttttttttgttgtttttttgagacagggtcttactctgtcacccaggctgagtgcagtggtgtgatcttggctcacctcagcctcgaccccctgggctcaaatgattctcccacctcagcttcccaagtagctgggaccacaggtgcgtgtgttgcgctatacaaatcctgaagacaaggatgctgttgctggtgatgctggggattcccaagatcccagatttgatggcaggatgcccctgtctgctgccttgccagggtgccaggagggcgctgctgtggaagctgaggcccggccatccagggcgatgcattgggcgctgattcttgttcctgctgctgcctcggtgcttagcttttgaaacaatgaaataaattagaaccagtgtgaaaatcgatcagggaataaatttaatgtggaaataaactgaacaacttagttcttcataagagtttacttggtaaatacttgtgatgaggacaaaacgaagcactagaaggagaggcgagttgtagacctgggtggcaggagtgttttgtttgttttctttggcagggtcttgctctgttgctcaggctggagtacagtggcacaatcacagctcactatagcctcgacctcctggactcaagcaatcctcctgcctcagcctcccagtagctgggactacaggcgcatgccaccatgcctggctaattttaaatttttttttttctcttttttgagatggaatctcactctgtcgcccaggctggagtgcagtggcgtgatctcggctgacggcaagctccgcctcccaggttcactccattcgcctgcctcagcctcccaagtagctgggactacaggcgctgggattacaaacccaaacccaaagtgctgggattacaggcgtgagccactgcacccggcctgttttgtctttcaatagcaagagttgtgtttgcttcgcccctacctttagtggaaaaatgtataaaatggagatattgacctccacattggggtggttaaattatagcatgtatgcaaaggagcttcgctaatttaaggcttttttgaaagagaagaaactgaataatccatgtgtgtatatatattttaaaagccatggtcatctttccatatcagtaaagctgaggctccctgggactgcagagttgtccatcacagtccattataagtgcgctgctgggccaggtgcagtggcttgtgcctgaatcccagcactttgggaggccaaggcaggaggattcattgagcccaggagttttgaggcgagcctgggcaatgtggccagacctcatctcttcaaaaaatacacaaaaaattagccaggcatggtggcacgtgcctgtagtctcagctactcaggaggctgaggtgggaggatcactttgagccttgcaggtcaaagctgcagtaagccatgatcttgccactgcattccagcctggatgacagagcgagaccctgtctctaaaaaaaaaaaaaaccaaacggtgcactgttttcttttttcttatcaatttattatttttaaattaaattttcttttaataatttataaattataaatttatattaaaaaatgacaaatttttattacttatacatgaggtaaaacttaggatatataaagtacatattgaaaagtaattttttggctggcacagtggctcacacctgtaatcccagcactttgggaggccgtggcgggcagatcacatgagatcatgagttcgagaccaacctgaccaacatggagagaccccatctctactaaaaatacaaaattagccggggtggtggcgcatgcctgtaatcccagctactcgggaggctgaggcaggagaatctcttgaacccgggaggcagaggttgcggtgagccaagatcgtgcctttgcacaccagcctaggcaacaagagcgaaagtccgtctcaaaaaaaaagtaattttttttaagttaacctctgtcagcaaacaaatttaacccaataaaggtctttgttttttaatgtagtagaggagttagggtttataaaaaatatggtagggaagggggtccctggatttgctaatgtgattgtcatttgccccttaggagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgggagcacccagcgcaggatcactgtgaacataaatcagttaatggaggaagcaggtagagtggtgctgggtgcataccaagcactccgtcagtgtttcctgttattcgatgattaggaggcagcttaaactagagggagttgagctgaatcaggatgtttgtcccaggtagctgggaatctgcctagcccagtgcccagtttatttaggtgctctctcagtgttccctgattgttttttcctttgtcatcttatctacaggatgtgactgggaagctctggtttcagtgtcatgtgtctattctttatttccaggcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcctgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttatgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctgccagcacctgaaagcttcctcgacatctgttaataaagccgtaggcccttgtctaagcgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatctactttttttttctttttctttttttttgagacaaggccttgccctcccaggctggagtgcagtggaatgaccacagctcaccgcaacctcaaattcttgcgttcaagtgaacctcccactttagcctcccaagtagctgggactacaggcgcacgccatcacacccggctaattgaaaaatttttttttttgtttagatggaatctcactttgttgcccaggctggtctcaaactcctgggctcaagtgatcatcctgcttcagcgtccgacttgttggtattataggcgtgagccactgggcctgacctagctaccattttttaatgcagaaatgaagacttgtagaaatgaaataacttgtccaggatagtcgaataagtaacttttagagctgggatttgaacccaggcaatctggctccagagctgggccctcactgctgaaggacactgtcagcttgggagggtggctatggtcggctgtctgattctagggagtgagggctgtctttaaagcaccccattccattttcagacagctttgtcagaaaggctgtcatatggagctgacacctgcctccccaaggcttccatagatcctctctgtacattgtaaccttttattttgaaatgaaaattcacaggaagttgtaaggctagtacaggggatcc

SEQ ID NO: 3422 - DNA, 4203 bp, Homo sapiens
  Genbank Accession No. U75968
ttcactgaggggacccgccagtttcaaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacattgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtgttttcggcccctccctggctcttaccaggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagcgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgyctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccattaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggttaaaaaaaaaaaaaaaaaaaaa

SEQ ID NO: 3423 - DNA, 4840 bp, Homo sapiens
  Genbank Accession No. U76366
taagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaagcactggcagccatgaatgcagctcaggtgaagcccttggggaaaagcccccaggtgaaacctgcctctaccatgggcatggggcccttggggaaaggcgccggcccagtgccacctgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcgtcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaacccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggcgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccccctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacaatgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagattccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtaaaaaaaaaaaaaaaaaaaaaaaa

SEQ ID NO: 3424 - DNA, 716 bp, Homo sapiens
  Genbank Accession No. U76376
gaaacttggtgtccaggggaggcccccggcggctggagcgcggcggcagcgggcgcagaggccggagggagaggaggcgaggggcggcccgagcgcggggcgggagcgaggccagcggtcatgtgcccgtgccccctgcaccgcggccgcggccccccggccgtgtgcgcctgcagcgcgggtcgcctggggctgcgctcgtccgccgcgcagctcaccgccgcccggctcaaggcgctaggcgacgagctgcaccagcgcaccatgtggcggcgccgcgcgcggagccggagggcgccggcgcccggcgcgctccccacctactggccttggctgtgcgcggccgcgcaggtggcggcgctggcggcctggctgctcggcaggcggaacttgtaggaacgcggggcttcttggtggggccggagccgagacccagccggagcgagcaacaggttggtgaaaaccctgtgtccttggagaaagctggttcccgttttccagagggggagcccagagcttgaaaggccgcggttggcacttcgagaaggaagtggagagtaaagacagcgcctggagcgatcgtagaaacacagaatgggactggggaagccctttggaaatccagctgcagaaacagacaccccaatgctatttacatacagctctatatatataaaaaaagaaaatatgaatattaaaaaaaaaaaaaaaaaaaa

SEQ ID NO: 3425 - DNA, 1773 bp, Homo sapiens
  Genbank Accession No. U77396
gtttctctccctgcccccgcgacttcgcgcaagatccgggaaggacacccgaggcccctgggagaccctggggaggtgaaagtcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctgggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaaaaaaa

SEQ ID NO: 3426 - DNA, 3084 bp, Homo sapiens
  Genbank Accession No. U77413
tccggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctaaaaaaaaaaaaaaaaaagggcggccgc

SEQ ID NO: 3427 - DNA, 770 bp, Homo sapiens
  Genbank Accession No. U77594
accggtccggaattcccgggtcgacccacgcgtccggcgggacggtcaggggagacctccaggcgcagggaaggacggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgcgggtggtaaccagtggaagaccccagcccccagggagaggaacccgttctatccccagccatgataataaagctgctctcccaaaaaaaaaaaaaaaaaaaaaaaaaaaaaaaaaaaaaaaaaaaaaaaaaaaaaaaaaaaaaa

SEQ ID NO: 3428 - DNA, 99014 bp, Homo sapiens
  Genbank Accession No. U78027
gatccgcccacctcggcctcccaaagtgctgggattacaagcgtgagccaccacccagggcaaaagatactctcatcacctcagagattctaagggttttaaaagctgtaattcgcgaaaatgaggatgaagactaccatggtttgaatgtttgtcttctccaaaactcatgttaaaatttaattgccccatgggcatggtgctcacgcctgtaatcccagcactttggggggccgaggccagtggatcgcctgaggtcaggagttcaagaccagcctggccaacatggtgaaacattgtctctagtaaaaatacaaagattagctgggcatggtggtgggcgcctgtaatcccagctactcgggaggctgaggcaggagaatcgcttgagcccaggaggtagaggttgcactgagccaagattgcgccactgcactccaatctgggcaacatagtgagactccgtctcaaaaatatatatatataaataaaataaaaatgaaaaatttaattgccattgtaatgaaatcacctttgcaaaattataactgaggaaattatgacagtgaaagaaatcagacctaaccgactccaccttgcttctaacctttaagctgtccttgttcattcctgggcataggtcaaactaactttgggaaggaattcagtttgtggtttgattctgaaacaaaattgatcataggcgtttctttcctggggactagtctgcctgtgcaggactaacaaattagctacaagattagaaattacagtttaggggtcatgcagcctctggctccaagagtctgaacctccccaaattgctcctggggataacatcactattgtgaaacctaagatcagtgcctgagatacttttcagaccctgaactcgatggagcagctgacaccacccagacctgtaatctggctcaaccagttctgccatcccacccagaacacaaaactgcaagaaagactcacttcgaccccctatgattccatctccaacctgactgatcagcactccgtacttcccaagcccctacccaccaagttatctttaaaaactctgatcccagccaggcacggtggctcacgcctgtaatcccagcactttgggaggctgaggcgggtggatcacctgaagtcaggagttcgagaccagcctggccaacatggtgaaaccccatctctactaaaaaatacaaaaattggcctggcatagtggcgggcacctgtaatcccagctactcgggaggctgaggcaggagaatcgcttgaacccgggaggcagaggttgcagtgagccgaaatcacatcattgcactccagcctgggcaacagagcaagactctgtctcaaataataataataataataataataataataataataataactgatcccccaaatgctctgggagactgatttaagtaataacaaaactctggtctcctgcacagccggctgtgtgtgaattactctttcttcatttcaactctcctgtcttgataaatctctgtctaggcagcaggcaaggtgaacccactgggcggttgcagtaatagtattaagaggtgagacttttaagaggtgattaagccatgagggctctaccctcacaggtgggattaatgccattataaaagggcaagatcggtctcctcttgctctatctcttggcccttctttctgtcttctgccatgtcatgatctagccttcctcccctctggaggacacagtgtgtgcagggaccatcttggaaaaagagaatggcctcaccagacaccaaacctgcccacaccttaaccttagacttcctatcttccagaactgtaaggcaataaatttctgtttataaattacccactatcgggtattgttatagcagcacaaaacaaactaaagactaaatgtgtacttcacaatatcacactccctccctcccaattccaatccattgccaagtcctgcagattttacctcctaagaaaccctaaaatataccaatcccctccatgtaaaccatggttattgtggtacaagctactattacctctactctagattgttgaaatggcttctaataaaactctccatacattctgactccttcccaatcctttatccacactgtagccagggcaatattttcttttcctttctttttttttttttttttttttgagacagagttttgctcttgttgcccaggctggtgtgcaatggcgcgatctcagctcaccacaacctctgcctcccgggttcaagcgattctcctgcctcaccctcccgagtagctgggattacaagcatgcaccaccatgcccggctaactttttgtatttttagtagagacggggtttcaccatgttggttggccaggctggtctcgaatgcccgacctcaggtgatccacctgcctcagcctcccaaagtgctgggattacaggcatgagccactgtgcctggcccccagggcaatattttcaaagacaaatctgattcgttctccccatcccacagggcttccaatggctcttaggatatagactgaatggcttaagatggcttgtaaggccctgcatgccctgacccaacacactgctgtcccaactgcctgttgaactccagccactttcattcagtctcttttactcaccatgccatctctgaacacatagcctcaaaccagctcctccaactctcacctccaatctaattagccactattcttcctttaactctcagctcaataactgcttctttgaagcaattcctgaccaccttgactagtcgaatacccctattttataggctctcattgcaccatgtaccctccttttcatgatacttgtcctcattgcaattatacacttgcatggctatttgcttgctacttggctccccactgtactatgagctccttgaggacaggaacttaataggtgtttttcctcaaatttcctcagcacccagtacaatgcctggcaataaattggtggtcttttttttgtttttgtttttttttgagacggaggcccactctgtcacccaagctggagtgcagtggcacaatcttggctcattgcaacctccgcctcctgcattcaagtgattctcctgcctcagcctcccaagtagctgggattacaggcgcacaccaccatgcccagctaatttttgtatttctagtagagatgggggtttcaccatgttggccaggctcgtctcgaactcctgacctgatccacccgcctcggcctcccagagtgctgggattacaggcgtgagccactgcatccagccaattggtggtctttttaaaaagaattgtaccctggcaggtcatgctaatatatactactagaagcactgtctgagagtgccttccgccaatgggaaacagagccagatactagtcaaaagcagtaaagccatattttgagtactattataatagaggaaaagagacttcagtatagaactaagctcaatccaaagacaactaggacaagtgtggatttacagtcaagcagcagagtgagggagtcagtagaaagaaaattcctaaggggagagagatatcaagggtagggggattcttgctcaactgactaaacaggattctcgctcaaggcaggacaaggtgatcaggtatcaagggtgagggagttactcagcaggactcttgctaaaactgggctaggcaggccgaggacagggcccaaggacaaggtgtagttgaaaagaaagctgagaggagcctgtccaaagtttgctcaaagagactttgttacttcctcaggccagtgtatgtttctttatctttatgtcttactttgctgctagtctccccacaaaatagatcatatccccactactctttacttattattccataggcattttaagagcttctttgagttataatttatatttcataaagttctcccccttttcaagtgcaaattcaatagtttttagtaatttatagagttgtgcgaactatcaccacaatctaagttgggacattttcgttatctctaaaagacgctccatgcccatttgcagccactcccagttcccaccccatagctgcttttgaaagccatcatatttgcctaaggatgaaaggtacagcctcactggaaaagcaaaaatcaaaactaccacgcgtgaaataatttgagaaccaccaagcactaattgtgcatttctgattattttctcaaaaacatttaaagacaagtcaatgtgaactaaggagtgggaggaggtttcaaggaaaaggtagaacattttaaggtttttctgcagaggaaaaagtgagcaaaaaaaaaaaaaaggaaaaggaatttaagttgaaaaatactccaacaaacgaaccaacatgttttcagaactttttgaagttccagtatggtgctgtcacggttggtgagctgtctgtccttgatccagtagacaatgcgagtttctagaacagaaggataaggatttatcacaagccataaaagctgaagcaacactcaactgaaaataaacatgtattgagcgcctactgtgtgtcacgcaaggggctctgcgcaggaaaaaaaaaaaaaaaaaaggctcctcgcagctccccctgccccggccaggtggctgcgtgcccccttccgcctaatccctggactgccctggggctgagaactcccctggcgcgagaagctggactcccccggggaccggcccgagatcactcggagtcgggggcgtccggcacaggccagacgcaaggaggacccagctggggccggcccttccttcccttctcctgtcgcacgactaggcctgtgcccggtcccacctgccgccctccccctcctcctaatgggaccgaaaagagcccgaagggcctgggagggcgggtgaggttcccaggcctttccagatgccctgccgtgtttggcaaagcgattgtcttccctcttggagctccgcggacacccgacccctcttcctctccctcgccaccttccgtcattcgccacgctgaccacttcccctctgctgcctcccgctgaagccccagcccggccgcggccgccatttcccgacagcctcttccctgtccctttccctgaaaggaaatgtactggggcggggcggggcgctgtgtgagggtctcgagaaagccgccggggagaaggagggatggattctttccaaactctctccgctctcccggagccccctacctcaccctttctccccgaattcttgtgggcttgggagcgagagagaaggagctggtcccagcgctagtcaccgccaccctcagcccacagatcggggggggcacgggtactcgtacaccaccccataaggatcccagccatgtcctctttccttcgccagagctcatttcctcctcccttccagcttcctgccctttccccaagacaaagttgatgtttgccttccctgagactcaatttcctcatctctaaagtgggatgacacgtaagaacatcttgtatatgtgaaacatgccctgtgcaaaagaaggggagcaggaagagggatacagggagaaaaagggccgtggaaaaagggtccttggaatgtacgggtagatgttctaaagaatgtatcggtcagagcattaggataggttcagaaaataattactgaatatattattttgattcttagatgttatctctcactatttatctcttctttcagaagcctaacattctcttctcagagggccagatcgatgtgtgttgtgtgcatttatctgtgctgaccactgctgtgacggaggtggtggggcgtccattcacaggctgcaggcacagggacaacataactgtggaatcctaattagaaaaaaggagttaggctggctggagcaggggaaggcaaagggagaaagcaaataagctataagtttgtctttcttcatggtccagaacatataaacaaaaagaggaatcagataagctataggtctgcttttctttatggcccaggacatgtggcttcttgcgcagataacatacataactcacaaacttcctgctcactatcaaacgcctcaatttatcaaacaccccagctaacagaagaatgcaagctagctccctactgccttggttttctcaatcagcccaaaaaccatcctataaaatctccagcaagcctttgtttcttttcagtcggctcctctcttgcaggctgcccgttgccttctcgaaacgtattttcctactttctctaataaatctgcctttacctccaactgtcttggtaaattattttacccctgcaccaccagcccagttagtcgacactcccccgcgacgataacccctcaccttcccagcggagtcctgcaccatgctaacctgggccccttgggcatgcctgctttgcactcatgagaagacagttttggtcattgtgggagcagcttgtaaagggttcttgtgacactcccagcctggtataaggcacagcaagtggaatttccttccatcagcagctgttttgcaatagccctggaggcccatcttggagaaatcttcattttagctgacagcactaggaattctacctgatggaaaaggagcttgatttataaacatattcgcaatgcattttcgtatcattttgctgggtagagaaggcagagaagatatgtcatgcttacacatgggattgtctctgttttggttacctcctttagggttggatgagtgaatgcaggaatcaatgaatgggtggataatggaatccatgtatccatcagccagtagtttcctgcagcagaaccaccctgagcacttgttaaaacacagcttattggctggacagaggttcacacctgtaatcccagcactttgagaggccaaggcaggaggatctcttgagcctaggagttcgagaccagcctaggcaacatagtgagatcccgtctctataaaaatcattttaaaaaataactgggcttggtggcactcgcctgtagtcccagctactcgagaggctgaggtgggagtatcacttgagcctggaattcaaggctgcagtgagctgagatcgcaccaccgcactccagcctgggcaagagcgagaccctgtctcagaaaaacacaaaaaacaaaacacaacttgttgggctccacacccagtttctgattcagtccttgggggaaagggacgaggcggggggcgggggggcaaaaagaatctgcatatctcacaaggtggaggttcatgctgttactgatcaggtaccacacccagagaaccactggcacaagccatcggatacttagaccacgataactgtggctgcaaattttctgcctgatcctgccaaatagctcacacacgcagttgaaaataaatcctctgactcagtgtttggggggtgttgtgggtggactgcccactcgacctcccatcactttcctgggtagtagtgttagatgtgagtgttggagcacgaatggtggtgggtgtgcacgcgtgtgcacaccagctgtactgctgtccctttgcacacctctagtgctgaccgctgaccttctccaggttctctctcctttgctccccagagcccttctgagtcttcttagccagcgaagaagagtaagtgaacatctaagatcacaaagaaccctctattgtctcctgggatttggtgccatctagtggctaacttgagaatctttgctcagacttagagaaacttctggaaaattaactaagtagcctgggaaggcaaaaacacctacttgtttaccctctgagaaaggcttcctgaagggcaaggactggctcaacatgataggagtcaaaatggatttcttgctctcctgaaagctgtgataaaaattagaagtcatcaaagaatctcaatcacgtctcactgcatcttcagcttgaatgattttctagaattgattttcatttcctgaatgaaacggagtcaggtaataccaacttggtatttgcctcccatctcatttctctgggccccaagccctgaacagcccaagtatagcaatccagtccccaaggggtcagtgaaactacagagatctgtagttcacggtacagttggtactgataagagggacatcagggccttaaagttattgaggggtggaattgttaatgaccactgtgatccagacagaaatctaagatatcagcacacaatgccacagcagctcaaaatcctcattaagaggtgcgaggtattgtaaatatgtggtttggactttaacagaaaatttaaactacttgttatgggaacaaaggggaggcaatcagggatcataaaggaagctgctccttaaagttgctgtttggggaactgtgatgggtctcaaaacgtggtcttgagaccagcagcatcagcacattctcaagcaacatcccaaaactactgaattggaaactctagggatggggcctagaaatgaatgtttaaacaacccctgcagatgattctgatgcacatgaatgtttgagaaccgctggtttaagataagctttagatgccctaaaatacacctgagagtgtttatagagaatctactaatgaattcatggaggagacaatttatttccataacataaacctgcttcttttttatgttttgtttttaacacataattgtaagcctacttctttttaaacatacaaacgtgccttctagtttgtggtgaaataaaaaggattatttatttgctttcacttctttggattttagagaatactatcttggtaagtacagtctccaaaagtagctcaatagtcctgtagacatggtaagttttttttaaaaaagaatgtacaactttaatattaatcaaaaaaatacaaattaaaatagcaatgagatatcatttctcaactaaaaaactggcaaagttcaaaaagaataatgtgcatcaataaggagggtataagggggaaaataaaacacacactccaagtagaaagataaagtaccagaatctttctggtaacacaaatcagaagccttaaaaatgagtatatctttgactcagcaatcccatttctagggatatatcttagaaataattaatgatatatgcaacaatgaacatataaagatgctaaatatcatttataattttaaaattaaaaatcttaactttgagggaattgtaaagtcaatcagtgtgcccatatgacagaacataataaaaatcaatcagttcaagattttttccagtttttaaaaggaagatttatttaacaagtttcacttagtacaatacatctaaatggaaatcacaatacaaggaaagatttaaaccaaagcctcagattttcatacaaacgacacgaccaaacttctaaagtattggtattacatcttaaaattgtcccgtatccttaaaaaaaaaaaaagtgtacactcacgtgccttacaggatattaaaccaaaaagctagaattaacaaacatgccaaatgttttcactttgaatcgtagacacagctcctatatttgagttttacagaaaggcatgtttctcaacatgcatccgaagttttcaatgtatttgtggtataagagcaacatttaacataagtgaaactgcattaacctaaatacgcttactgcttaggtacactcctacaacataactaacttgaggaaagctaaaaattgttttaacagttatggtcaatactgaactttgttattatgtcctagatgaatgtttcagtgttcaaaattactgagcttgaagttttaaaataatctcaacttccactttacagtaagcatgaatcacaagcctgtaatgcaaaactgttaaacttaactcgttttcttaaaaaaggagaaagaaagataaagaaagagaagctgaccaagagtgatcagaatcaattatatttcccatttaccaatcatactggatatactaaacatccctcccattctattcaactcccacaaatgtacagcttttatatctggagtagctatttagtgctccttctctacctaagcaaggtttgactgatagtcactggagttttcctgcagaacttggtcatatccactcatactgctctgaccaccataaccacctccataaccaccactcagctgctggctagcaggacctccataactagactggttggataagcccatccctcccatcatttggctaccataagcgccaccacttgcccctgctgtagaattcaaaaaaagttctacatagctgtgatcgtaagcacccccacttgttcctgcagtagaatttaagaagagctccacatatctgtgttgcatattagctttgtcttttgccatagctgccacagcatcttcatgagtagcaaattcaacatctgcctcaccggtaactctgccatcgggtccaatttcaatatgtactctcatgggattaagaggtgagaagaaattataaatatcattctcagtggctctgtaaggtaaccccctcatgtgtacacagtgccctgtggtgctctggaaactggacccaccatctccgtatctatgatcagacattcctgaaaaacagtaattgaggtctcttccaaatctatcagacccaaagccatatccatcattatagccaccatagtcatcatagcctccataccctccaccataggcaccacgcctcatcctttcaaacccagctcctctgccaatgctattataccctctgccagcccccggcctatcatagggacctggccgctgcatagccatgagctttcgagggggatcatagtgggttcgaacttcagctcggctactcttgaagatctcaatgtacctgtgccctattctttccttgtgtttctttaaggccttctcagctatctcctgtgaagcaaactgcacaaaggcttcccctgtgcttcgcccctgaaagtccactggcagtgtcatcccatttggcacaatttccaaccctgaaaagaactgaacaatctcttccttgctacagccaaatgggagtcctctaagccggacgaagccatcgttggcagtatcagggctattcggacctgtatgcttcaacacccaatccatttcaacactgttagacttgaatacttcaacgtatctgtgtcccatggtttctctgtccttcttcaaagccaatttcacttcctcttcagattcaagttcaacaaatgcttcaccacttggtctgccttctctggtgtagatgaaacgaatacctgatgtgccattttggatcttgcaatcagagaagaagcgcatcacttcatcggctgagcaggaccagggtaggcccctgaccttcaccacgaacccctccctgccttccgtgctcagcatcatggtgattgttgggctcttggtggcaagtttggctcaatgcaattttggtgtagctgaaaaaaaaaaaaagaagactactgtcatggaaaaatgctcgtgatatagtaagagaaaaaagcaaactattaatagaaaattcaattatgctgacagcttttctgtaagacgtctgtataaacagagagttcaccaaatttttaactcattcattttttagcagttatttattcaatgcctattacgtgttagataccattaaaaattaacagcaatcggccgggtgcggtggctcacgcctgtaatcccagcactttgggaggctgaggtgggtgtatcacctgaggtcagcagttcgagaccagcctggtcaacatggtgaaaccccgtctctactaaaaatacaaaaaattggctgggcgtggtggcaggtgcctgtaatcccagctactcgggaggctgaggcaggaaaatcgcttttatgtacccaggaggtggaggtgagccaagatcacgccactgcactccagcctcagcgaccagagcaaaactccgtctcaaaaaaaaaaaaaaaaaaaaaaaaaaaaattaacagcaacaaatcagtgggagatgtcaacaaataaaagatggctatatctgaatatataaacataaaaaacttcactagatcaaaagattaaacaacaattaaaacacaaacaaaacacaggttatgtaagttctttatataatatcttcattatataaaaatgtatgcaaatcaataaaatcagggaaatatttgggctccagagataaatgaaaaaaagacattattgggaattcacacattcattttagaaacattttttagttgccatgtccaatattcggctctggcatacaagaatcaataagcccagaatgggcttatggtcctacaggagcaccgaatgtcattattaaagatgtaaatgcaaatatacattatacttgccatgaccctctgagtggagtgtaagcatagtatcaaagagggactagttgatcagttctattggttggaggccaaatggttaaatgaaacagactaatctgcccagggatccataaacatttttttttcttaattatgatgaagcacaaataggagagggaaaagcaagtgaaaagactggcaaggcatagatcagatcccaaagactttgatatacaaacactaagcgccttttaagacttttaaaccggggagtatgtagggtgacttcaccaaaactctttcagacagatcaccctggcaacagcgtggcactcaaacagaagggggtcgacgtggaactagggagattagttagaacttgtctcataaatatatgttaaaggaatcgcctaaggcaacaggagtaaaatggagaaaagatgtatctacacataccaaaaaaagtggaatctgcgggacttgataacagattaagtatgagagaatacaggtataggaggatacaggagaggaatctgggaaatgttcaaatttaatcaatcttccagcaagttaaaatcagaactaatcgttatttttcacccatcaagataatggaaattaaacagcaacagtaaatcagtgctatgcagttcacaaactaatacactaccagaagagtgataattgatataaactatttcctttttgataaaccccactatatcctgaaagcaatttgataatatgtatcacgccttttgacagcaaatacatttcagttatgtgccctaaggagatgatctgaaattcagacagatttatggagctatatattctttgaaaagtactttattaagaaaacgaatattatgcatttaattttaaaagttacaaaaatatttaataacatgagaaattacttatgctataattgtaagtgacccaagagcacaactgctttacaatatcaactgtgtacaaaatacatgttcccataccctttgacactgctagaatccttccaggaatctagtcaacagaaatacttacaaatgttccttgcagcactgttagtaatggcagaaaattggaaacctaaatagccatcattagaggaatggctgaatgaattatactttatccttaaactggaatgcaatgcagccatttaaaaaaaatctatctgccttgacccagaaagatctccaaaatacattaaataaaagaatatacatagtatgatcctacttatagtaaaagattggcatgcatgtatatacgtatgtaaataaataaaagatctggaagcaaacttgtttttgagagaactgaagggtgggggggtgaagtgggcttttcgctttttaccctatatacttctatacagttttaattctttacatttgctgtactgggattttttctttttaagttagaaagaacatattagtggttactctgagtgggaggtttatggattttccatgttatttttccaatttttttatgcagccttaaatttctacagaaataattacttttacttcagcaaaaaaagtaacataaaacaaattaaaatgtttgcatttctgggatttggtataggaaattttataaaattttctaattttgtatgtggatggtttatctgaaatggtctgggagcactgggcctcttggaaacaaagtacaaagtgtaataacggccataaaactacactgaggaaacgatttaacaaacatttactgattgccgattatgtgcctagcacactgcatctgcagtgataacagttttcctattaaccatcctaaggtctcagtgacagatttacaagctgtttttttatttcattttgcaggatttttttttttttttttgcttgccttatccctgggataacccgtcccatttaattccctgcaccgctctattccttaagagcccttctgtaggggcagagaggttctacttcattactgcgtctcctgggaaggccatcaggactgctggctaaagtgggaaccaggactctttgtgagttaagaatttgtgtatttatatgtgtgttatacacattttttaaaaaactgtaacgacatcaggttgagcagtcgtctccgggtggtgaattatgtgtatttttaaattttatactatattgttatttttcaaatgttcgaaattgaatatgtagattgttgttatcagcagaaaaataaacattattcaaatactctattcagtaaagtaatttattgggcgcctttgtcaagcacgcatttgcctagatgtgactctacagataaaattcacttggggcctccccttacagacaatcaggcagtggagactgagtgcctgaatggatagaccagcactcagaccactattttcagtatctgtttttcttaactcagggccgtggttttcaaacgtttttcgccttacggtcacccttagggtcccccgagaccggcccagacagacagatatacaaaaacacatacacagtcatgagcgtccaccatttccccaccaggcgcagcacaggcggcttcccggcactgagatgggggggaggagggagagagcgcgaggggggaggggaaagcagagaacgaaagaggcggaggcggcccccgaaccccgctctggtcttcatcatcaccacccctgggtccccagttcccacccacacaccaacctctaacgataccgggtaattttcctccttcttccctcaaacggctatagcgagacggtagacgacgaccagaactacttctgctcacgtaagcgagtaatcacgtgagcgcctacgtcatgtgagatctcggtcacgtgagcaactctcggcttaaactcgggatcactaaggtgccgcacttccttctggtatggaaatagggcgggtcaatatcaagaaaggaagagggtgattggttagcggaacgtcttacgtgactgattattggtctacctctggggataaccgtcccagttgccagagaaacaataacgtcattatttaataagtcatcggtgattggtccgcccctgaggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcaggtatcagatattgggtactcccttccctttgcttttccatgtgtttgggtgtgtttggggaactggagagtctcaacgggaacagttgagcccgagggagagctcccccacccgactctgctgctgcttttttatccccagcaaactgtcccgaatcaggactagccctaaactttctctgtgtgacctttcctgggatgggagtccggccagcggcccctgtttctttctctctctctctctctctcgttctccttctctttctctttctcttctttcctctctctttctctctctccctgcccggttctcttttttcactgctccttgcagagcagggccaccccataggcagtgtgcccaaagtagccctgcccggttctattcagacccttcttgtgaacttctgctcttcctctgccgggtgctaaccgttagaacatctagggtgggtaggaggaatggggaactaagattcgtgccattttttctccttttggggtcgtggatttctcggcagtatctcgagggagttagagagaccataaggtcgctgagatctctcccacctcgcccatgagcgtggcatcaggctggaaggttgacatggaggaactttatacatttacacctttgcgtgagggttgaggctggattagataggtattgaacatatctgaccctcacaatccttatctgtaaattgggattacaaccttttaatttcagggagctgacaaaaaaaatctgaaaaatagttcttatctcacacaggtgagttttcaaggagataacctatttaaagtacatagcacagcgcttgaccattcaactgcgcttacagagcaaatgttcaatgggaaaatgaatgtaaatctacaaatctgaatgaatatgtgtatttttctggagagaggatatttacctttcttcaaattctcaaagggctctgtgatttaaaaaaggttaggaatcactgatagatgttggtaaaaggtggcagtcacagtacatttctgtgtccataagttattcctatgaatatctttatagataaagtcaggatgttggtcagacatcacagaagaaattggccttgtaagtttcatgtgaccctgtggtacagtatgtgtggcaattttgcccatcacggatttttttttattggtatttgcatctgattataaaactaatgcatgatcattgcaaaaaatgtagataaagaagagcaaaatgaaaataaagatttccccccaccgttccaccacccagaaataatcatggtttaaatgttaatatacaaccttacaattgttttctatataaatgaaaacatagatttctttatttcattattttccataaaaaatggatcatgtttatgtcatgtttggctaatggcaagaccctggcacccagtctgggctcaaattctgcctcattgttacttagccctgtgacattgggtaaattacactttttttttttttttttttttgagacggggtctcgctctgtcgcccaggctggagtgcagtggcacgatctcggctcactgcaagtccgcctcctgggttcacgccattcttctgcctcagcctcccgagtagctgggactacaggcgcctgccaccacgcctggctctttttttttttttttttttttttagtacagacggggtttcaccatgttagccagggtggtctcaatctcctgacctcgtgattcgcccgcctcagcctcccaaagtgctggtgtgagccaccgtgcccagccttacttttttttttgagagggggtctcactctgtcacccaggttggagtgcagtggcgcgatctctgctcagtgcaaactccacctcccgggtttaagcagttctcctgtcgtagtctcctgagtagctgggattacaggcacaccaccacggccagctaatttttgtattttcagtagagacgggtttcaccatgttgcccaagctggtctcgaactcctggcctcaagtgatctgcccgccttggcctcccagagtgctgggattacaggtgtgagccaccgcacccggcctcttttttcttttttagtctatcataccttgcaaatacagtggttcttcctatgtgttggttttgatatttatgtaatcaaacacatcagtttttcctttctgatttctgactttggggtcatgctgagaaagtcctttcctacctgaagataatacagtatatacgtttcttactagtatttttgtggatttttaaaatatttaaatctttagtccatctgaacttgttcttctatcagaaatgccacatttaataaataataagtcccatggtatcagatggctggaaggacctctttcgaaactttgtttaattccattaatctgtgtattcttattctaatgctaatagttccacactagcttcctttatcttttttttctttttttttttttttttgagctggagtttcgctcttgttgcccaggctggagtacaatgtcacgatctcggttcaccgcaacctccgcctcccaggttcaagcaattctcctgcctcatcctcgcgagtagctggaattacaggcatgcgccaccacgcctagctattttgtatttttagtagagatggggtttctccatgttggtcaggctggtctcaaactcccagcctcaggtgatctgcctgcctcggcctcccaaaatgctgttattacaggcgtgagccaccacgcccagccttcatcttttaatgaatgtacatgtatgtaatcttttaggtgaactttttgtaatgttgtgccaagttccttaaaaagcccttttggaagctgggcaggtggccacgcctgtaatcccagcattttgggagtctgaggcaggtggatcacttgaggccaggagttcaagactagcctagccaaaatgcaaaaccctgtctctactaaagatacaaaaattagccggatgcgatggcacatgcctgtaatctcagctactcgggaggctgaggtagaagaatcgcttgaaccggggaggcagaggttgcagtgagcaagatggcgccactgcactccagcctgggtgacagagggagactccatctcaaaaaaaaaaaaaaaaaaaaagataaaaaggaaacctaagtactcttgggctttgttaaggattttgttaaatatacaaaggattgcagggaaaattaacttatttttaatattgagtatgcttatccaagagcaaaataatatttctccatttattcaaatcatttaggagcatcatagttttaacatatgggccttgcacgtatcttaaatttatctctaggcattttaggttgttcagttgttcttgtgaatgggatctttttctccaaataggattattgttgatatctgttgattatgttaactttgtagtttctgactttactgaactgtcttcttagatctaatactcttttcaatttcatcatatatttctcattcctattttgtttggggtttttagggcgggaatattaacgggataagagagacaaaagaaaatctggaaaaacaattcattttaccttacattgcttgtgattactaccacactattactgggttggaaaaaattgtgaaatcccaaggtgcctaataaatgggaggtacctaagtgttcatttaatgaattgtaatgattattggaatttctctttcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgtgagtttatagataatgttcttgttcattcagaggactgtaagcacttctgtacagaagcttgtttagaaacagccctcatggccgggcgtggtggctcacgctgtaatcccaacactttgggaggccgaggcgggtggatcacctgaggtcaagagttcaagaccagcctggccaacatggtgaaaccccaactctattaaaagtacaaaaaattagctgggcatggtggtgaacgcctgtaaccccagctacttgggaggctgaggcaggagaatcgcttgaacccaggaggtggaagtttcagtgagctgagatcacgccattgcactctagcctgggcaacaaaagagaaactccatctcaaaaaaaaaaacaaggaaaaaaagaaacagccctcatgacacttagaaagtagaatagctggctgttatctgaacattgaattgtaaggcttatcaggtggactttgcattccatcagcagacaatttttttttttttttttttttgagatggagtctcattctgtctcccaggctggagggcagtggtgcgatctcggctcactgcaagctccacctcctgggttcatgccattctcctgcctcagcctcccaagtagctgggaccacaggcacccgccaccatgcccagttaattttttgtatttttagtagagacggggtttcaccatgttagccaagatggtctcgatctcctgacctcgtgatccgcccacctcggcctcccaaagtgctgggattacaggcatgagccaccgcgcctagcctacaaatgttttgtaatagctcttgaggcccatcttggagttctccttttgctaaaaccactgaactctctaggaggaaaaaggaacttggttcttgacatatgtgtgcatgtatttccatataacctttaggaagctattgcaatggtactataaactagaattttagaagatagaaggaaaatattctggagatcattgaagagaaatggagtccaacactagttaaagatgatgaagacagatttttttttttgacggagtctcgctctgtcgcccaggctggagtgcagtggcacaatctcagctcactgcaaccctccacctcttgggttcaagtgattctcctgcctcagcctcccaagtagctgggactacaggcgcacaccaccacgcccggctaatttttgtatttttagtagagacaaggtttcaccatattcgccaggctggtctcgaactcctgaccttgtaatccgcccaccttggcctcccaaagtgctgggattacaggcatgagccaccacgcccggccgatgaagacagattttattcagtactaccacagtagaggaaagagccaagttcaattccaaatacaacaaagacaggtggagatttatagccaatgagcagattgagggggtcagtggatggaatatttaagaagacatcaagggtagggagcttcttgctaaagcttcatgtacttaaacaagaagggtgggggatgagggaaattgatcagatatcaatggtggcagtattgacttagcaggattcttgctaagaggtcttgctaggacagacataggaagccaaggtggaggtctagtcgaaaagaaggctcatcagagaagtctaactaaagtttggtcaagaagagtctttgtcaaggtaaatctatcatttccctcaaaaggtaattttcaggatcccatcaggaagattagcatggctgctagctttctcctcagttctgggctatagctcacatgcctagtttgaactagctcagcagaactgggggatttattctttgtcttccaacaaactcatctggatgattttgggggtttgtggggaaaagcccccaatacctggtgaagtaaccttgtctcttcccccagcctggaatggttctctctttctgctacctcacgattgtgcttctacaatggtgactcttttcctccctctcatttcaggttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggtaatgtttcattccagagatttagccacaaaggaaagaactttgaggccatggtagctgagccaaagaaccaatcttcagaattttaaataccctgtcacaatactggaaataattattctccatgtgccagagctcccatctcttctctttcagttcattaattaattaattaattcatgtaaaatccatgcatacctaaccatagctaatattgtgcacttataattcaagagggctctaagagttaattagtaattgtaactctctataacatcatttaggggagtccaggttgtcaatcggtcacagagaaagaagcatcttcattcctgcctttcctcaatatacacaccatctctgcactacttcctcagaacaatcccagcagtctgggaggtactttacacaatttaagcacagagcaactgcctgtccctgctgctagtttaaacatgaaccttccaggtagcctcttcttaaaatatacagccccagctgggcatgatggctcatgcctgtaatcctagcactttgggaggctgaggcgggtggattacttgaggtcaggagttcgagaccaccctggccaacatggtgaaaccccatctctagtaaaaatacaaaaattagctgactttggtggcacatgcctgtaatcccagctacttgggaagctgagacagaagagtcacttgaacctgggaaacagaggttgcagtgagccaagatcgcaccactgcactccaccctggatgacagactgaaccccatctcaaaaaattaaaataaaataaaataaaataactatatatatagccccagctggaaattcatttctttcccttattttacccattgttttctcatacaggttataagcacatgtccttggccctgaataggactggcagaagcattgtgtactcctgtgagtggcctctttatatgtggccctttcaaaaggtgagatagtgagcccagaatccaatagaactgtactgatagatagaacttgacaacaaaggaaaccaaggtctccttcaaagtccaacgttacttactatcatcctaccatctctcccaggttccaaccacttctcaccatccccactgctgtaattatagcctaagctaccatcacctggaaagtcatccttgtgtcttcccctttatttcaccattcatgtcctgtctatcaacagtccttccaccagtatctctaaaatatctcctgaatcagcccacttccttccatcttcactacatgcaccctggccttccaagctactatcggctctcaaccagactgctgggaccacctgatctctctgcttccactctgtctcaacccccatctattttccaagcagcactagagttatcatattaaaatgtaaatatcagttttttttttaaagaaaaaaaccctgagacttaacagagttataaaaaatataaatgtcatcatcagttccctgcttaaaacccttaactcgcttccaattgcacttggaatgaaaccaaactgcactgatccagcccttgcctgcctccccaaagtccaaggggtcatggctctttccctggctacactggttttctttctgtccctcaacactgcaagcctattgctgccccagggcctttacacttgctttttttctgcctagaacagttcttccccaaagatttttaaagggccgggctccttaacattgaagtcgcagaccaaacgccacatatgcagacagttcttctctaactactttaaaatagccctctgtccattcattcttcatcacattaacctgtttaattttcttctcagagctccacactatttggaagtatttgttgacttgttaccatgtctccccactagagtgtaagtttcatgagggcagggaccttgtctgactttgactgtatctctcgcatatggttaagtgttaaatagttatttatggaatgaatccctattattccctcattatctctgcaaaatagtcttttttctcaacatcttaaacctgatatcccacctgcctatctacaaactttttttttgcgacagagtctcactgtcacccaggctagagtgcagtggcgccatctcggctcactgcaacctccgcctcccgggtttaagcgattctcttgcctcagcctcccagtagctgggattataggcgtgcgctaccacatctggctaatttttgtatttttagtagagatggtttcaccatgttggccaggcttgtctcgaactcctgacctcagatgatccacctgcctcggcctcccaaagtgctgggattacaggcatgagccaccgtgcccagcctctacaaactttttattccattaacaaactatatgctgggatttaagttttcttaatacttgatggagtcctatgtaattttcgagcttttaattttactaagaccattttagttctgattatagaagtaaattaactttaagggatttcaagttatatggcctacttctgaagcaaacttcttacagtgaaaattcattataagggtttagacctccttatggagacgttcaatctgtaaactcaagagaaggctacaagtgcctcctttaaactgttttcatctcacaaggatgttagtagaaagtaaacagaagagtcatatctgttttcacagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatggtaaaaacttgagccctccttgttcaagaccctgcggtaggcttgtttcctattttgacattcaaggtaaatacaggtaaagttcctgggaggaggctttatgtgagagtacttagagcaggatgctgtggaaagtggtttctccatatgggtcatctaggtaactttaagaatgtttcctcctctcttgtttgaattatttcattctttttctcagttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacaggtaaataagagtatatattttaagatggctttatatacccaataccaactttgtcttgggcctaaatctatttttttcccttgctcttgatgttactatcagtaataaagcttcttgctagaaacattactttatttccaaaataatgctacaggatcattttaatttttcctacaagtgcttgatagttctgacattaagaatgaatgccaaactaacagggccacttatcactagttgctaagcaaccacactttcttggtttttcagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgtttattttattgccaactactacttcctgtccacctttttctccattcactttaaaagctcaaggctaggtggctcatgcctgtaatcccagcactttgggaggctgaggcgggcagatcacctgaggtcgggactttgagacccgcctggacaacatggtgaaaccccatttctaataaaaatataaaaattagccaggtgtggtggcgcacctgtggtcccagctactctgggggctgaggcatgagaatcgcttgaacccgggagtggaggttgcattgagctgagatcatgccacctcactccagcctgggcaacaaagattccatctcaaaaaaaaaaaaaaagccaggcacagtggctcatgcctggaatcccagcacttttggaagctgaggcaggcagatcacttgaggttaggatttcaagaccagcctggctaacatagtaaagccctgtctctactaaaaatacaaaaattagccaggtatggtggcgagcttctgtagccccagctactcaggagactgaggcaggagaatcacttgaacccgggaagtgggggggtgcagtgacccaagatcacgccactgcattccagcctgggcaacagagcaagactccatctcaaaaaaaaaagttctatttccttgaataaaattttccgaagtttaaactttaggaataaaactattaaacccgtatttactcatccagatacccaccccccttgttgagattctctcccaattatcaaaatgtgtagcatatttaactaccaagagctaaacatcattaagactgaaatgtattaagaaggatgtataggccaggcacggtgtctcacgcctgtaatcccaacactttgggaggccaagtcgggcggatcacgaggtcaggagatggagaccatcctggccaacatggtgaaaccccctctctactaaaaatacaaaaattagccaggcaggtggcaggcacctgtaatcccagctactccagaggctgaggcaggacaatcacttgaacctgggaggcagaggctgcagtgagctgaggttgtaccaattgcactccagcctaggtaacgagcaacactccatctcaaaaaaagaaaaaaaaaaagatgtataatttggaactgttaagaggcattttaaagaatggatattttgtctcttaagattcttccaccggggagtttggccagacctggtggctcacacctgtaatcccaacatcttgggatgctgagataggagtttcactgaaggccaggagttccagactagctgagtaacaaagagagacacccaacacaaaaactaaaattagccaggtatggtaacaggcacctatagtcccagctactcaggaggctgaggcaggtggaccacttgagcctgcaagctcaaagctgtagcaagctatgatccacaccactggcacttacgagagggagaccctgtctcaaaaaaaaaaaaaaaactccactggggggtttcatacactagaaaacctattctttgtagttattttggtataaatatatctactttaaaatgtgagggggaatgtcaaaatgttcaagagtgtaagaccaagtccacagacaatgttatatatgttacagtgtactgtgtctgaagaacaatgccaaaattctttattaaattaactgttataacaaagatctgacacttatactctgtagcaaagacatctcatattcactatgaatgtgttactgacttctccctattagcctgaaatgtgtctactcacatgataaccaataaccattgcataatgacaaactgcctcataaggcccctagtgattgaagtgccaaattagaaaattgcaacatatgatgtgaactcaaccagtcagcttcaatgcaaaacaagtagtaccagtaagaggcataaatttccccacaagcggaattgtattgatggctctagcttattccctcccaaaagatgaacagcaaacaaatgaagtgaacataaactcaagattttattgtcttcataataaaagatgacacttagaactggatcacttggccctgtaacagaacagaaaaaagttgttttgtattttgccatgaactactgccccattaagaacattatctgttcctaaaatactcaccatgctgttaagctgcctcattcttcctttcctccttgtagcaaaagacctcacatatctttagctatagatctaatatttttagaggattacccctgagctctatgccacaatgaatagatgttcaccttttcaaataataaagctatgaaaaagattgcaccttccacccataattatatacctttctcttcttatctcctcccagttcaaaatgcttgcatcttttaatagccagcattctcttagatctgcagttgggctcaacgcactcaagccttagcacaatcttctttgtagttttagcctgaaaaaaaattaaattaaagccttaataaataactacagaagatcactttcttcaaaaatgactactttaagtactatttaaagcaaagcattgcaaatgaatagtggggcaactattcttttgcaatgctttgctttaaatagtactcagtatactcttaagccatagggagaaaataatctaaaaatcagtgaatttaagagaaaatgtgtagaacttgtggactaaaaaaaataaagagaaggctgggcacagtggctcatgcctgtaatcctagcactttgggaggccgaggcaggcagatcatgaggtcaggagttcaagaccagcctgaccaacatggtgaaaccccatctctactaaaaatacaaaaaaatcagccgggcatggtggcacgtgtctataatcccagctgcttaggaggctgagattacaggcccacaccacaagcccggctaatttttgtatttttactagagacggggtttcactatcttggccaggctggtctcgaactcctgacctcaggtgatccacccgcctcggctttccaaagtgctaggcacaagccaccgtgcctggccgcgtataggtacattttctttatccattcatcccgatggacactaaggttgcttctaaatcttagctattataaacagtgctacaacaaacataggagtgcagatatctctttgatataccgattttcttctgggtatatacccagcagtgggattgttggatcatatggtagctcaacttttaaatactcaatttcctaataagcttgcccctttagccagagttctgctgctgctagtttgcagttcttaataggccaaaacctagttagaacctctgtcttctaaacaagttatccgaatgtgaaaaggtataaaaaaagcattctttttgccaccctgagatcaaaccacttactgcatccaaatgagcactaaagtcattccttaatactttctggagctaaactgcacaagaagcaaagtgccaaaagaaatgctgtgttggagagaatgctccgttccaatcatcgtgctaattactttaagagttagccaaatcacctaaggtttgagagtaaacagaaactcgctcagcctgagaatacagaattcaggaggctagcagaaaggcctaaatggctattctataagagttttaagacttcacgagaacaggtagttgactgcagatttctgtgatgagaaacaacagaacaattcttagtgcaaccaacaagcgaggattcagacatattgacagataaggaacaaggcaaatgaaaggatttaccagtgtactcacacttcagttcttaggaaagcagggcacattcctcaattttttgcctcttcagaagggaaaggataaaaaatcgtaaacactgaaatagtgcagtattgtggactagtcagacatgagttgcattcccagctccatcacctactagatatatcagtgcagtgaaaacttcgctaaactaacgctatacctatatcatgaagtgtgtggactagagacaagtgcatatccttacggcaattaactgggaaacgtcaaatagtaactaccactcacctttttccggaaaatcggcttagtttgcccaccatagccactctgcttcctgtcataacgccgctttcctgggaaaacgaattggtatttgttataaaatactgaagatcagcaagtaagtcttacaggttttatcttaatttcgcagcagaaatattaacgctcaagccaggcgtggagggagagagacccggactcgtatgttattctacaacacaaatgtcacattaacaccaaattatgcggaatccatcttaccctgggcgtacagagaatccttgcccttcttgtactgtgtcactttatggggttggtgcttgccacacttcttacagaaagtccggcgggttttagggacgttaacctagtaaagaaacagttcagaacgtgcaatgttatttgaccacaatggcacaacgccctaccttacccagctaaagctgaggcactccaggaggactcctcattacttgctacctctgactacagggtgggccagccccatgtgcttcaagcagagcttcctccctccgtcgagccccaaagagggaagagacctcattaactccacccccggctaactctacctctttgaacccatcacttcaattcctggccccgtagcccggtccctttagggttgatcccggcaagattgggttgctctgatatatcgagtccacacaggagcctggacccatcccggcatagcacgggcgacgaagggggggaaagattaagctggatgttactcggcccccaccagcaagtcctaccatgcttgcgtgagcgctatcggcgcggaaagaaagaaaccgcgaggcaaacggaagtatataggaggttcccgatcgcacttcctcatgggagtcggtaggagcaatcatagagtgtaaggctcagcgcagcgccctcgggcggctgagaggactcagttcggagccgcgggcgggagcttaaggaaggactccgcctaaagggtggtccactcaccccgacttcctcccgccccgcagctttcaacgtttcgtcactttatctcttttggtggactctgctacgtagtggcgttcagtgaagggagcagtgtttttcccagatcctctggcctccccgtccccgagggaagccaggactagggtcgaatgaaggggtcctccacctccacgttccattcctgttccacctcaaggtcactgggaacacctttcgcagcaaactgctaattcaatgaagacctggagggagccaattgttccagttcatctatcacatggccagttggtccattcaacaaatggttattggatgcccattatgtggcaggcactgttccgggggagaggtacagtaatctaataggcttataaatgtgcaattatgaactaagtactttgaagaaaaggaacaatgattggcattaaagcagcacccttctgttgagggagtaagtcagcagctctaggttctgaaaagtgacaatgaaattgtttggctcctgtaatagcaatcatcaagcctagaagtagaaagtacctagcggctcttcccttccttgcaaacctggcagaaggcatatactaggtctcaagagagtccagcatagaaagacttcagggtgctaaacattttaaatagattgtgtcatacaattctcacaataattctaggagacaggtggtactattattctcattttacagattaagaaattgaggctgtaggatgttaaacgatttgcccaatgtcaacggtatttagtgaatctaggatacaaacccaagtagactgactctagagcccgcgttcctttaacattataaaatattgctgttgtggcctggtaattataatagctaaaaaaattatggcgcacttactatatgccaggcattctcctaaccaccttacatactaccccttttaatcctgacagcaaccccaggaggtatataccagtattagtatttaacaggtgaggaaactgaggcacaagagatgttaagtttacttacctgaagtcacacaggttgttatttttttgtggagctggaatttgatcctaggtagtctaacactatagccttgcacttaaccactacatcatacaaaggaagcaggggcatctgcagtgtagaggatggtgaggagacagaattgggctgagacacaggaggaggtggcagtggaataggggctgaagaaccgtgagagtctggggtatcttgcttgcacaaccctccaggaacacgcgtgggacctgagctgacactctgatcacccccttttttgttgggtggtctctgggaatgagataataaatatattaccactacctgctacatttcctgaaaatttctttgccaaacttccagcattttctttttctttccagattcttaagcaatctcactggcctttaggggtttatgttagtaacatggaaatatgaagaccgtgaacatggcccctcttcatttaatcaaccttagttctttctatcatatctggtgttatgtggctttgtgggggttttgcttgtttttgtttacttaaaaatatttaattgacaaaaattgtttatattcaaggtgtacaacatgatgatttgatatgtgtatacactgtgtaatgattaccacagtcaaattgattaacacatctatcatccatcaccatccatagttaccatgggggtggtgaggacacttaaaatctgctctcttatcaaatttcaataatacagtattattaactatggtcactatattgcacattagatccccagagcttatacatcctataagtgaaagtttgtacaccaatgctgacaccgaggtgggaggatcgcttgagctgttctctgttttggacatgctcctgctcattaatttcccctaagacgaggcactcagaactgaatgcaggactctaggtgtggtctggctttgcagagtaagtggcatgttaccttcctctgtctagatattttacttccataaggaagcctcaatgtcaccttggcttttctggaagccatgttaactgatgacatgccttttgattactatcagcaaaaacccctgaaccattttcacaaatgctactgctactccactttctcctggagtcatttgaagttcaaatttggggcccaattatgagacatcacctttagccctggtaaaatacactttgtggaatttggcttctcacaccaggtgatcaagatctttttgggaactaattgccctcttctgtcatccagtctagcacacaaagccttgcaccattcatagactaaccgggctactttttatattttcctcaaagatgatcaataaaaatgctgaacaggatagcaccaagaatagaaccttatattgcattgggaatctcttcaggtgacactcagctgtttatttgcactatctgagtacagtctttctgtcagtatggatgagtgtgctaggggagtggtcgtgggcagagggtgaagaaaagcctacgtctacttgctcttttcccttgtgctcctctctctctcttgtttagctctcccattggatgcctatcacctcccagtccccaccccaagatggatcttgagaaaggacagggcatgtgacaacaagtggcataagactgaagaaaagagcctgggcacggtggctcacgcatgtaatcccagcactttgggaagctgaggcgggtggatcacgaggtcaggagatcgagaccatcctggctaacatggtgaaaccccgtctctactaaaaatacaaaaaattagccaggcgtggtggcaggcacctgtagtcccaactactcaggagactgaggcaggacaatggcgtgaacccgggaggtggagcttgcagtgagccgagatcatgccactgcactccagcctgggcgacagggcaagactccgtctcaaaaaaaaaaaaaactgaagaaaagaggagggaagatgaatgcctgtggccaaccctcaggcaggtgagtggaacagctattgggggtgactagcgaaaggatagacgttgtcaataaagtaaggcaatcatacaacacatgctgtccatctgtcttgtgcaaatgtgagtatcaaccactctatcatcagtctacaaatactttaaatgtttttatttaaagtcctgttgatggctgggagaggtggctcactcctgtaatccctgcattttgggaggccaaggcaggagtatcgcttgagcccaggagtttgagaccagcctgggcaacatagtgaaaccccatctctacaaaaagtagaaaaattagcccagcacagtgatgtgtgcctatagtcccaggtactagggtgactgaggtgagaggatcacttgagcccaggaggtggaggctgcagtgagccatgatcacgccactgcactccaacctgggcttcagagcaagaccctgtctcaaaaaaaaaaaaaaaaaaaaaaggtcccagggcctgttggggcttgggggtgaggggagggatcttagaggatgggtcaataggtgcagcaaatcaccatgtcacacatatacctatgtaacaaacttgcaccttctgcacatataccccattttttttgtttgcttgtttgtttgttttttagacaaaataaagaaaaaaaaataaggtcctgttgacttaaaacttcggatgaaattgtagtgggacctgtgatctgtttctacattaggatacagtgccttggggcaaggaaatatggcagtgcccgaggtgtcaaggtgggcaggcagatcagtcagcaggggctccaccatcatggtctgcattcaatactggctgcatttcctaggagaatccctgggggaatcattgcagttggagcataatgtagggggcccctgagaaaacctccaggcttcaagtgacatacctagtctgctttaccggtttacaggactcaagagaaaggtggacattgagagttaatccctgaggccaaatcttaaatggagaaagtcaacatccacagaaaatggggaagggcacaagtatttctgtgggcttatattccgacatttttatctgtaggggaaaaatgctttcttagaaaatgactcagcacggggaagtcttgtctctacctctgtcttgttttgtcctttggggtcccttcactatcaagttcaactgtgtgtccctgagactcctctgccccggaggacaggagactcgaaaaacgctcttcctggccagtctctttgctctgtgtctgccagcccccagcatctctcctctttcctgtaagcccctctccctgtgctgactgtcttcatagtactttaggtatgttgtccctttacctctgggaggatagcttgatgacctgtctgctcaggccagccccatctagagtctcagtggccccagtcatgttgagaaaggttctttcaaagatagactcaagatagtagtgtcagaggtcccaagcaaatgaagggcggggacagttgagggggtggaatagggacggcagcagggaaccagatagcatgctgctgagaagaaaaaaagacattggtttaggtcaggaagcaaaaaaagggaactgagtggctgtgaaagggtggggtttgctcagactgtccttcctctctggactgtaagaatatgtctccagggccagtgtctgctgcgatcgagtcccaccttccaagtcctggcatctcaatgcatctgggaagctacctgcattaagtcaggactgaggtgggtctggggtatggcaggggctgggcagcagcagcaatgtaccttgcttgggacccctaaaaaccagagagacagcatggctggtgccatttatcagctagtggaggaggctgacggagggtgggagtgtcatcagcacaaggccctggcagtcccttctggtgattagagaggccgaaagggtcctttccgacaagggctgagggtgggcggaacaggaagagaaaaatgtgacatgaggtgaccatccgaacaggtagcaaatgttagaaaggggtacctctggcaaacttagtggaaaagtaatattgcagggagcagtcagataaaaacaagcccttctgtcaaatagtgcttgaagactcaatagggatacatgggtcaatgaagcctttagaaaaagaaatactaagaggcagattctctgagaacatggtaaaagctcacgctccacgttatgaagttgacctttgtgagctagggaaaggcctggctaggccagggtgtaggctacctgccttgagctgtaccaggccaaatgtcgccagggtcagagctggcttattaaaggactgtgtggaagctgtgccaacctcgtggtaacaatgggtaaaagactgggccaggagaaagcagcctctgcctcagcccagacagtgcggccaacccttgaggttgtggcaaaggtttctcctcttaccattgccctccatgtgcatggcttgcttttctcttgtcttcattatttctcctttcctttcctcctctccaacctcctcctcttcccactcatcctcttttctctacctatatcccctcttcattataccctcctctgttctgttgattaccagaccctgacatacagttagcacttaacaaataattgccgaattgcattgactttttcttgctcctttcttcccccgctcttttcccttttcctttccctttccatttcctcctccctgcctgcctagcaccttccccataaggtggttgtgagcagtaaatgtgcaaatacatgtaaagcttttaaaacagggcctggcaatagtaagtgctggatctcagtatttgctataatttttactctgcctcagacctgccaatgtcccccagagggcctacctagagcaaataatatgacatttagaataaaagtgattggtgaccccaatcaagacatccttggataagttgcccagactccagcctctctggagcctcagttatttgataaaataatgtcactttccaaataagccacaaaatgcaaatactcatggcaacctaaagcattatacccaaacagtgtcccttagggcttgtcctgtctattctgactccttttatattcaaactatttaaactgcttgcttgtgttgaagtccaaatttccattgcgtatggctattgatatttttgtttggaattttttttttttttttttgacacggagtttcactcttgctgcccaggctggagtgcaatggcacgatctcgggatctcagctcaccgcaacctccgcctcccgggttcaaacaattctcctgcctcagcctcccaagtagctgggattacaggcatgtgccaccacgcccagctaattttgtatttctagtagagacggggtttctccatgttggtcaggctggtctcgaactcccaacctcaggtgatctgcctgcttgggcctcccaaagtgctaggattacaggcgtgagccaccgcacccaccctggaattctttgtaaactccttatggtgcgaactaatgtaactttccatccagttatgggggattggtgcaattttaaattatcactatgatttgctatttccatttgagcaaatttcctatagagtttcctttcagtggactagacccatatcaggaagtgacttaggtataaagggaagatacagctttcgaaaaccaaagtttgggcgttctccaaagagttatcagatacccccttctacacccacaatgatctgattgctgagatctgattgctaactactgaaaataaggaagaactagaattttcagtgacacagtgctcagcaagaagctagaaaagaggccttgacatatttgactccaaagctacttggttatgcatgaagccatctggggaggggaaggaggagggagaactcctctgaggaccctgaaacaattgggccacgtgtgactttcagtttctatggagattcatgtgcagtggctgagggcaatctgagagcattggaaacccagaagctttaataccaggctcttctctccgctcttagaaagttctcacaagatgtctttaggattatattggttatttgaatctcaaggagaagctcctctcactgccctacctccctgaactgaaaacaaactgtagtctgttagctcaccctagaagaaggaaattctagagtcaagagaagttaagttttagacaagctggaagttggaatatactggagtttaagatcattgactcaatgaaaaaaaaaaaagatttgtctgcagtaaaaccagagttttaaaaatgattagaaatggaccagaaaagagataaggataatgagaaagggggctctctaaaactatttggaactgaaattgggacaatgtttctggaaactattttggcagtatgtatcaaaatgcaaaatgcacatacttttttgactctggaaatgatgcttgtatagagatcctaataacatgggaaaataattaggaataatgttaaataagaacattagatctttttttggaaaaaggtaccttgaacggatggatggatggatagatacatacatacatgcatacatacatacatagatgttacgaaaaataggtaaattaactgaatgtgcaatatgatctcaaatattataagaaacacacacagaaaaaaatggaaggaatatgccgatatattaatgcctctggatgagtttatgaatgattttttcttttttatatccctgtacttgacatattttctacaataagcatgttttattttactatattttgttttattttgagatgggggtctccctatgtttctcaggctgaccttgaactcttgggctcaagcaatcctccaatatcagcctcctgagtagctgggactacaggtgcaccccactgcacccagctgcgtgtgttattttgatatcgatggaaaaaataaataaaatgtttaagccaaggaaaacaaaaactaggttgaaaaagaaggccaaaagggcacacaagtccagagtgaaagacagacaccccagcagtcaccctcagagcagagggagaatattgaaagtattaccactgatctgatctggcactgactataaacttgcagattggctctctggctctccttccatcatcagttggccagaatatattgtcgctaatgcaagacaaaaagagatgatgaatcacagagacctagaagtttccaaaaccacagaagaaaaatgtaaaatgctaaaaacataaggccaggcgcggtggctcaagcctgtaatcccagcattttgggaggccgaggcaggtgtcatggtgtgcggctgtagtccaagctactcaggaggctgaggcaagagaattgcttgaaactgggaggtagcgattgcagtgagccaagattgcgctactgtaccgaagcctggatgacagagcgagactctgtctcaaaaataaataaataaataaataaataaataaaacatgaactgctgtggaagaaccagagagccctaaggcctcctgtaaatgactacagcaggagagtttccctggtcagcatgcagctttcgaaaattgagtttggcttgatgccttcatcacaaatttggtcccctgtagccttgactatgaagcttatcataaaataattgggtttcactggggcccgaacaaaagcatcttgggaatttaacaagattaaaggttgctttgttgctgtgggtatgatttttttttcttttttctttttttttttttttgagacggagtctgactctgtcacccaggctggagtgcagtggcacgatctcggctcactgcaacctccgcctcctgggttcaagcaattctcctgcctcagcctcctgagtaactgggattacaggtgcgcgccaccacgccaggctaatttttgtatttttagtagagacagggtttctccatgttggtcaggctggctgctctcaaactcctgaccttgccatccagccgcctcagcctcccaaagtgctgggattacaggcatgagctaccacacgtggccatatgtaaattttaaacatgtaaaccaatactgtatatcttttatagatatttacatctgtaatgataatatgaaaacgtacctaggaatgataaacaccaaattcaagatattggtaatctctaaggagggagaagactaagattttggagtacataaaggggtcttgattatatagatagtatttcagttcttaacacgttctcttctggtcccaaggccaaggaattctcaattgaaatctcagttagaacgtgaaggatgcttcttgggactgggaagagattttccgtaggccaaatttaacctcccactagagatagttgataattctaccacatttcatagtgaagcatcaggaagacaggactgaaaaggcaagaaggaatgatgcaaattgcatagtccaaaagataagctggacctaggtttgccagtttgtctaagtaactgagaattcattctgagatcaaaaaatcaaaataatgttcacagcagcattgtttatcactgaaagcaaacaacctaaatgtccatcaacaggagaatgaataaatatattggaatgtattcatcatatagaatattttatgcatataaaaatgaattaaaacatatgaagtagaactagccagataaataaatcctaacatattatattgaggggaaaaaagcaagttgctggagaatgtgtaccatatatatatatataaattttctttttttttttttttttttttcgcgaccgagtttcactcttgttgcccaggctggagtgcaatggcaagatctcggctcactgcaacctctgcctcccgggttcaagggattctcccgcctcagcctcctgagtagctgggagagtagcgttggcccagctagtttttgtatttttagtagagacagggtttctccatgttggtcaggctggctgctctcaaactcctgaccttgtcatccacccgcctcagcctcccaaagtgctgggattacaggcctgagttaccgcacctggccatatgtaaattttaaacatgtaaaccaatactatatatcttttatagatacttacatctgtaataataatatgaaaacatacctaggaatgataaacaccaaactcaagatattggtaatctctatggagggagaagactaagattttggagtacataaaggggtcttgattatatagattgtatctcacttcttaacacgtgaggcaatatggcacaattttaggattttgtagagctaagcggtgagtccaagattgtaatgttatagtccctgtactttctatttgaaatatttcataatataaaacaaagtatatttgaggccaggtgcagcagctcatgcctgtaatccccacactttggaaggctgagacaagaagatcacttgcatccaggagtttgagactagcctaggcaacaaagtgagacccgtgtctctacaaaaaaattaaaaattagctgggtgtggtagtgcacacctgtagtcccagctacttgagaggctgaggcaggaggatcgcttgagcccaggaggtggaggctgcagtgagtggtgatcttgctactgcactccatcctgggtgacagagtgagaccctgtctcaaaaaaatagaaggtatatttgatcaaagttttatattcacagtaagcaataagaaccctagggacagagaagggtggatgttccacctaaacactgtgctttcattccatcaacaatgaaacatccaggaaaggaaacaacaagtgactctagaaattcactagttagacagaatctccttgggaatgatttaaagagggaaaatgtaagaaaacctggcaagactaagaagagtcctcaagtgcaaaaaaagtatagttgacagttaccagagacagatcatccttaccagcctggaggaatattgcagaggaaagagcttaggatcttgaatactctcttatctcctgtatttaccaccatttcctctcttgctgaacattcctagaaaatggagaggagtttgtcacaactgctctttgatgatagccatggagaatgacaggggccccaaggcagatggcatcaacctcatcaaagaccaaaaaacaaataaacgaacaaaaatccctccggtaggcagtgaaacaccacaaaaaaagcaagggctatagatgatataccaagagctacagatggatgaggttggacaagtcacataacctctgtgtcagtttcctcatctgtttgttgtgaggaataaatgaaataatgcctgtaaaatgcctgtcaggtagaagtcactgaaaggaacagaagttccattccatccccctaaggaaagacagggaatggccagaatcttcctagccaattgagtagtgctttcaaggagaaatcaagagaaaacactacttcttggatattttggctaagtagtcatttgaagtacagttgactggttattttattttaaatcatatctcatagactcttcccaatcataggctggctgtgtagttttctgaattttgctctggtattcttcttcttttttttttttatttttattttttatttttttttttgagactccaggctggagtgcagtgtcacgatcttggctcactgcaacctccgcctcccgagttcaagcgattctcctgcctcagcctcctgagttgctgggactacaggcgcctgtcaccacgcccggctaattttttgtattttaatagagacgggatttcaccatgttggccaggctggtctctaactcctgacctcaagtgatccgccagcctcagcctcccaaagtgctgggattacgggcatgagccactgcgcctggacttattattcttaatagtattttatcttatgagcgaagataagagcccaagatggtttagtttactgattctgcaagtgctatttctattaattccttggcatactgcagtttgtatgatggctgcactcttgttaataagcttcgtctttctgaattctgttgctccatagggagctgggaggctgcaaaaggtggccctgtaaaaatctttgcatttataatttaataaaggggacattgtaacactggaactccatattttaaatgaagagctctgtgtctattttttctcctcccccatttctttctttctataaacaacagtggtgtgtgtgtgtgtgtgtgtgtgtgtgtgtgtgtctgtatgtttgagacattcaagtcacttccatttccacccttcaccctgagtggagctcagggttagccatcattgtgcatattttgtggtcaaaccgactctgtaggctactgaaattgttttaaaaaaattggggcctttactggccaggcacggtggctcatacctgtaattccagcactttgggaggccaaggtaggcaggtcacctgaggtcaggagttcaagaccagcctggccaacatggggaaaccccacctctactaaaaatacaaaaattagccaggtgtggtggcacacgcctgtaatcccggctacttgggaggccgaggcaggagaattgcttgaacccaggagatggaggttgcagtgagccaagatcgtgccactgcactccagcctgggcaacaaagcaagattccgtctcaaaaaaaaaaaaaaaaaatggggcctttcacaataagtacccacagaagctttaccctctaactactttttaactcagagctgtgtgttacacaccaaccttctggaggactcaaaaatggatccctttcctttcacattattgagtgatggaccagtggcacctaaggaagagctaccacattttcaggctgtgtgagtctggactggatcataagaaacaggagaaaagcagtcaaagaaggtggtaccaaatcatggcaattctggtagacctctagctcaatgatctagaggtggaggccatttcaccttttgctcagaggggcgatggctagtgagagacttgcttacttcctcatagtcagagcagcactaaaccctgcccaaacacagatacttgagagagaggaagacttcctcttgtacaaactggatttgttctaaaacagagaaagagtagaggcagcttccagaaggacctgtcttataggaagtaagagcaggggacaagaatgaaacagatggtgggtctaagcagggaatgtatccaccaagagcctgcaacaaaactaaagataaaatgttgcctgcgatttattcggctaagagaagtacaccagacatggtttgttgggatgcttctgaccccatttactggtcacagtactcaatttatttagggttttattttttatcctgtaatttgagtctttgattgtgaagaggtacttaattataatttgccacaagaataattgtggtatgattacagggctctcaatgagttggtagttcctgagaatagagtagtattatttggttaccactactcctgagtaaatgcataattgtaatgttaaaatgaacctctttgagtttagagctaaaactgagtgttgggaagggctgattgtaaactcatcaatttgtcactccagtgagagaccatttaaaccagggagtcagggtgtgtggcagggtggagggaaaggtttgcactcttgcccaatttttctcaaaatctaatttacaaaatattgaattaatccacctccagaagatagtggcatacacatggtagataagtggcaaagcgatcttccagaacacccctggtgttcctttgacgtattttcgtctccccagcatgagaatagaacctcctacaccacaggaaagagcaaaataacagtgtggatagcccccaggctttgataaaattcactcccttgctttcctagtgtgagcaataatctgcttaaaaagtagaaaaaaactgctggctttattcattctgcttccacggtgccaccaaaagcataaggagtttacttaaaaaatagacacattcccacccccacccccccaccagaggaaaaatccctaccactaattaaacttgaatggagggctggtggttttttcgttacttacttagtgtttttttgttgttgtttttgattttgttttttgagacggagtttcgctcttgttgccccgactggagtataatggcacaatctcggctcactgcaacctccgcctcctgggttcaagcgattctcctgcctcagcctcccgagtagctgggattacaggcatccaccactacgcccggctatttttgtatttttagtagagacggggttttgccatgttggccaggttggtcttgaactgttgacctcaggtgatccgccagcctcggcctcccaaagtgctgggattacagatgtgagccaccgcgccggcctagtgttctatttttatgacagcatttgttttcactttatctttccaatgaaagttcggaattagtaataatattacactgtgcataaactgtaagtgaataactgatatgaagtgttgcttggtgtgaataaaaaagccagtggtgactttgggaactttatttgtctttctgtgtttcagttacctaaattgaatccttctggagtattgtaggtttggggaggctaaataagttgtgtttcataaatgaacagaggtggcatctatatcagtaagacagttgcatcacttttgcatgatgctgtctaaaagaactaatttaagctaaatggggaaaaggtcagaaaacaacaactaccccccccccaccaaaacccaccaaaaaaaattatgttttcaactttagaacaaatcttctatcctttgtagctcagtcagtgggtgtgggcaaaatcagttgggcagcagttagtgtgtgtccagaactgcaggtgcagcctccatatccttattagttcccttggttacagaccccagtgggacaatgtttgaaaaattatattcaccgtctaggaaattgggaactgaaagtccaatatctgcctcagtggagttctggcacctgcattatcccttctgggtatatcaagatcaacagctgcacagatacttttgcttttcacagattctacacatatcatataaaggtgaatagtgtaaagctacctctacaccttaccaagcacacaggtgcgtgccatttaacatctagagcattccattgccttatacaagaactcagtttatatgagctcacaacatcgaaccaatccccccccaattcagtgtgcatccattatacctgaaacctgacagagctgggggctgtgggaggaggttggtaggaagaaattattttgtgagctgtgcacatttttgttccatttgaaactaggtagctaggctgagggggaaccaagagggatgaggattaatgtcctgggtcctcaggaactttcattatcaacagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtggggtaagtttctcgactatgaaaactgagtttcaagatatcaaggacttggccttagatctttcttggggaagaggtaaattttcgttggtaggaggaggggagtagaatggacctaagttctttcaaattcagcaaaatatttcctagcctataactagctaaagccggaaagtcaaaggtcctaagaagccacaaggaaaatattaccatggaatcttggaattgatgagcactcattaaatgattgttgaaaatgaaatcgaagagttggaaattgcttccttacttcctatgaggaaggtacatacagtcattcactcttccatggtatttgccctccatttggtagtcatagatttatagatctggaaggatttttttttcttcccccacatgacaggtcctggtgccacctcactttgttgaatgattagataacaaaatctaatcatctggttgcttaatccctcttaatctttctccattttcttcctcattctacttctcagagaagaggcagtaagaagggttcaatagatgttgagaagatcacttgtgttgaaacagtggttcctgaaaaaaatcctcctccagaaagacagattccggtaagaagagaccaatgtctgagatggggaacagcagatttgaagaaatttgcaacatttaaattctctgtaaatagactggtgatgctgtgcaacgtggaacacggtcaagtttcctttaaaaattcttcactctaccatattggttataaagaatcttagcttctttccttcatattcagaacatctcactaaacatggaaaatttgttaacacaaacttttaaatgatgctatatctagttttcaaactggtcagagatcattgattttattccctcagttctctcaggatcagatttagaggcttaagtaagtctgaatgtcataatcctagggctctgagtcacatgatatcctttaataccttactatttattctcttctcactttccggagcgagagacataaaacctactgatttttgagttcacttttaaaaaatatatatcaatttcagtattttctttttttcttttttttttctttttttagacagagtctcgctctgttgcccaggctggaatgcactggtgccatcttggctcactgcaaccttcacctcccgggttcaagcaattctcatgcctcagcctcccaagtagctgggattacaggtgtgcaccaccatgcctggctaatttttcgtatttttttagtagagacggggtttcaccatgttggccaggctggtcttgaactcctggcctcaagtgatccgcctgtctcggcctcccaaagtgcaaagattacaggcgtgagccacccactgggtctgaccattttcagtattttcttgatcacaggagaattgcgtatttattacagaaactctggaatatataaaaaatacaaaaagattaaaatgatgcataatcctgttacccagttaaaacaactatcaacatattggtgtacatagacttacagatgtttttcttcactgagaacacatacgcatacacttatatatatgtcatatatttaaaacatagactcatagtacacatcttgctttgtaacgtactttttcaatgtaacgatatgtgggaaacttttccccatgacaatagatattctttaataacatgattttaatgactgtatggtattccctattatggatgtattgtaatttgtttaatctcccattattacacattcggtttgtctacaagtacttgatagtataaaccatgttgagaggaacaatcttgcatacatctttctgtactttttttattcttttccttatgataatttcctagaagtaaaattttgttcttctctttaagaaaatctgtgcactttggttatttttatctttttatttcattttctagaagtggaattgaatttcatacacacctacaagctatgtatgagagtgcctgtttctgtacattttttccaacactagatattttgttatttttattattattattattttctgagatggagtctcgctgtgtcgcccaggctggagtgcagtggtgcgatctccgctcactgtaacctctgcctccggttcaagtgattctcctgccccagcctcctgagtagctgggactacaggcgcccaccaccacaccctgctaatttttgtatttttagtagagatggggtttcaccagattagtcaggctgatctcaaactcctgacctcaagtgatcctcccacctcggcctcccaaagtgctgggattacaggcgtgagccactgtgcccagcccaacactagatattttaaatattagttaatttgacagccaagaaaaatagcatttcaggtggggcgtggtcgtcacgcctgtaatcccagcactttgggaggccaaggcaggcagatcatgagcaggagttcgagaccagcctgaccaacatggtgaaaccccgtctctactaaaaatacaaaaattagctgggcatggtggcgcgagcctgtaatcccagctactcgggaggctgaggcaggagactcccttgaacccaggaggcggaggttgcagtgagccgagatcgcaccactgcacatccaggctggacgacagagcaagactccgtctcaaaaaaaaaaaatagcattttattgctaacttattttgcaatttcttttactcataaagttggtctactgctcatttatattttaattttgtgaattgcccattaatttttggtccattttttacattgagatgtttacctcatttctaatacttttaaagagatcttgatataagaacatttatcctttaactgtaaagtatgttgaaaatgtttttcagtttatcctttatctttcaattttgtttatgatgctttttgccatatagggatttaaagtctatgtcatcaaattagttcaggtttttcttaatagttctaagtttcatccttatattagaaaaagcttgcctcccacaggattatataaataattgcttatatttactctcagtcattcatagttttattttttatattaagctcttgaatccatctggaattttctttggtgtatggtgtagcatagctacctaactcctctcctccccacaacgttagtggttaaatatttgtcccaacaacaattttttagaaacctccattttcccagtgatttgaaatacctgagtctctcttgactgggtatgtgttgggtcgtattggatatgtgtccctattggcctatagaaagtaatcactaagaatcagccttgtctgtgcaggagaaacttctgaagccacagcaaaaggcttctagtacctaaggaaattcagaaaagagcaatgcatcaaccaataaccattttttcttatttcattacagagaagaggtgaagagtccagtgaaatggagcaaatttcaatcattgaaaggttcccttatcccttccaggtgagttattttctctcaccaaatctcgaaaggcccctgtaacacaattagaaggggtggtggggtgcagggcagagggaaggctacgaggacccagtgaatagaagttgaggtggacaaggatgctgaaccaagaaatgagactggcatgggctaagaatgtttgcttttctatttacctaatctaacatagtttcttttagtctctatacctcaaaaagaatacatagcagcaccaattctatcatagtgtgtcttgtctatgataactgcattgagaaagatgctctgcttgttgagtgagcatttcacttccttctggttctgactatctgtctaatagtggtcatgtgggttgaaaagatagaaaaggggagtagtattaggaagttcagtatgaggaagacttattagacttatgcataaacctaaattctgttgtaatctggaagagctgaagtgccacatatgcatctgtttaggagagcaagaactacaaatttggtcttcagtttggcttgcttacatcctgagaactctgtaggccacatgtcgtgaatatagcagcctctgcaacagtgaaagccagaaaaggaagtggaaagtctcaggggagggggctttctgtcatggatttatgagcacagcaagactaacaagcaaaaagaaaaatgtaaaaggatcttgttcgtgtccctgactatatcaaatttacgaaacctttgaaagaggggtatttcagacacagtttttactaccaatgcctttcaacaagatgacattgtttggctgcactagtgaacaatgctgaacagcagataattttaaattaatttatatttgacttcagaatttattatgtgatgtctataaactctgtgagggttggaaccacatcttatatatttcatgcatcttcgtaacacctagcatgatgccttgtacatggttaaaaaaatactatttgacttgatgatattgcttattatataccttaccctttttgaagtaggtttgtagttccaaatttgatttattttggctaatattggtgaggggaggccactaggtagtggaggtggaggtaattagccatgaattaaaattttactccatattatccaagtgaataacccatatgtactaatcaagacttaatttatatagattatcacttcatttctcttctatacaaagtcagaatttaataataagataaaataccctttgttggataaacaaaaatgttatctccagcaagggcagacggagaccttataaaataagtttatgcatgaattgaagcacaagtcaggaggacctaagagtatgaaaaattctaagagcttttaaacgctacattcctagatatgaagagttcaggaatccttcagatagttcacataacctgaacaccattgctgactgaagattctgcctttctttgttttctacaataaatatacaaattgtcccctaagattagtactttcaaggtctttctccttttttctgaatcctaactgctgaagtctgtgttttcatcgacccaggttgtatatgatgaagggcctctctacgtcttctccccaactgaagaactaaggaagcggtggattcaccagctcaaaaacggtgagaattatttggaaaataaatgtttccaaagaaagaaggaaaggaaggaagaggagatagacgggaggaaaaggaaagaaggaagagagaaacgagaaagaaagagaaaggagaaacgtagagagaaaagaagaaaaaaatggatagaaggggagaaaagaaagagagagggaggggaggagggagacaggaaggaaggaagcaaggaaagaaggaaggggatgagggaggaaagaaagacaaataacaaagaaacaaaggaaagtttgtattttgtttcaatattagtaatacaattgagcttagtattccatcatatgaataaaagataaaatattagactaagagtttcccagttctatcactatctctctagtgcaattttgtaattttaggcacctccatttctctatttattaagaaaagtcccattttttgcactgaatacaagggtggtgtggcattcaatggttatgcaatatttagaatcctaagtataaaatacctagctccaaaaaattaaatagatgatgtatgagagtgcttgaagtcagagtcagagaacctggtttcaagccctcttttaccatttacaaactgggtgatttctggcaagaaggccaacaagcttctttgatgctcagtttcttcttctcaaaggagaataatggtaattcatgccacatctacctctggggttgttgtaaggatcaaatgaagtaataatacatgtaaaagcacatggaaaactgtaaatcactgtatacgaaagcactgtacatctctttgttgtggataaatatttcccaaggaaatatttcatattccttgctttgtgaggacctaaacttgaacagtttcagcatttcacatcaaccatacagtgtgttcagataaacttgactgtaaatgcttgcagcacaggatgcatgcacacatatttgtgtgtatatatagccacatgtcaagtgactgagagattaactggttgagttgacatcaggaaaggctgcctagagaaacaggaaggatggcagactgataatggtatggttgggttattgcatgacagccctttgtcttaataaacatttagattctgatactcactggctggctataccagccttgtacactcccttgaatgcaagtttggttggtcaaaattatattagccaagtctttcaaactgaaagggaacaggaggaacgaagatgaaggatcatctattcaattattgctatgtgccagatattgagctaaataccttttatatattatctcatttaattttcacaacaaccttggcctaaaaacaacaacaatgataactaacacttaatgagcacttactatgtagcaggctctgtcccaagtgcttcaaatgtattacttatttgatctttgcagtagccttaagaagtatgtattattcccctatttacagatgaggaaactgaagctcaaagatgttatgcaacttgctcatgggcacacagtgaatggtggagcctggattcttatcacatccctgtgtctgtatgactccaaagcccaagctcattgcatagttttgcgctgcttggtttccaagtccagaaatttcacatgtagttggttgcaaaatattctatagtaaagctatgttgaatattacaaataggtgatatcctgcaatacacagttcagttcttggcatattttaagataaggggtctgctttagccctggggctacaaaatgagcaaactctttaatactgcttattgtgatacaggctcttctttaagttctttacatatattaactttgtattaaccatatgaggcagttatcttgtcatccccattttacagataagaaagctgaggtacagagaggttaagtaacttgcccaaaggccctcggttggtaaatggcagggtcaggctttgaattcaggccccagactccatgtcctgaaccaatatactatctccagccacagaaatatttgcagagactgggataagagctctgcaggacatgtatacttgtacttctttagttctctccacaatgcctcatacagcgccttgcacacagaaagggatcagtagttgtgttaactgatttatctgtgggaataaacaaccatcaccagcttgggctccacatcgataaatggctaggttttagtctggaaatgggggaatgcaaggcagactagctgaaggagaaataagggagaaactggcatgctcaagttggtaacttctttacacttcatatactaatttcaaaaccagtcatagtttagtccaacaaatatttatttatttatttatttatttatttatttatttatttatttattttgagatggagtttcgctcttgtcacccaggctggagtgcaatggcacgatctcggctcactgcaacctccgcctcccgagttcaagcgattctcctacctcagcctcccgagtagttgggatgacaggcgcctgccaccatgcccagctaatttttgtatttttagtagcgacagggtttcaccatgttggccaggctcgtctcaaactcctgacctcaggtgatccacccgcctctgcctcccaaactgctgggattaaagcatgagccaccacacctggcccaacaaatatttattgaatgtccactatatttaagggtgagtaatgaccgaagataaggatatccagcttgtgagcttgtgagctttctttttttcttttttttttttcttgatatggagtctcactctgttgcccaggctggagtagagtgacgtgatgttggctcactgcaaccgccgcctcctaggttcaagcaattctcctccctcagcctcccgagtagctgggactacaggcgtgcaccatcatgcccggctaatttttgtatctttggtagagacagggtttcatcatgttggccaggctggtcttgaactcctgacctcaggtgatccacctgcctcggcctcccaatgtgctgagattacaggcgtaagcactatgcccagccgagcttggtttcctaactcagatgttaaccttacaatcttgattatgtgctgcttttaaggttcattagctaagtaaattcacaacaggctaaaaataaagccaaaataaataaacagaaacaccatcacttcagctgggtcatcagtgtgatcagggagtgtggctaggcacatctttgccttctcttcccttatgtttcaccaaaggcattttttttcccagtagttccacctgggtatagtcttgttgaaccgtcctgggctaacaacaagagccaaaaagtaggcaccttctgacaaataccatgattgctgggagatttaggtgcaagtcctaacaatcccaggacagtcccaggtgctgccaatgtcaatagtgagttagcctaggagccacaaaataatgatattattccactctttttgtttttttcttgtttgtttttatgtttttattatcctactcttgggtaaaatgcaccaataagaaatcattgacatgaaaaggggacctcatgagaatactggttacctttgcagggatattgactgaagaggcatgaggtgctggatctcaaggaggttaaatgggtgtggaaaaatatggtttgctgtacacattaaatctgtgcactttattatatgtaaattatacctcaattttatttatttatttttttttattttgagagagagagtcttgctctatcgtgcaggctggagtgcagtggcacaatctcggctcactgcaaactctgcctcctgcgttcaagcgattctcctgcctcagcctcccaagtagctgggattacaggcgctcaccaccacgcccagctaatttttgtatttttggtagagacgggatttcaccatgttagccaggctggtctcaaatgcctgacctcaagtgatctgcccacctcagcctcccaaggcgtgagccactgcaccaggcctatacctcaattttaaaagcatagcctcagatacctcatatccagctgccacattttctcaatggtgcttgccatgcaaaggttgtattcctgtgggcttagccacagactctctctttccatttccttaaatatggcagtgggcccttctatgttccagcaccacaaatatttgcctatacttattcttgaatctttggtcaagctcaatagaacctatcctaattgcaaattcaaaagtaggcaaatgacctgacctcaccaaaatgaataagagaatagcattggcaaatctcctacaaacagtatggaaaggaatgattcatgtatgcctgaaacagaattttagacattaacctcataaatatggatagaaaagaccagcccatcaagtgcttggagaatatgtactaaccattagtgcttcccaataggggaatgtgcattggtgaagcaagcagtctcccccagccctcccacttgtacaccctgcttttgcaatcctgtcctaagtagctggaaataccagctttggattagccaacaaaagaaggggtgtcatcttcaagggacctcttaagaggcagacattatttgagaatgtagggaggtttcttaatgagtgtgctaggggtggggaagacaagaagccttatttcccctcattatcgtattagcaagcttagtttattagagtggctaattgtcgattaggtattctttggcatgtctactggtgcccagccctgcagaagacagagcaaacttgaggatcttcaaatccctaggtgacagggagtggcatgcggggaggggccagagtgtggatgtggtaggagtaatcaatcctggcagggaggagtatcaatgacattgttcacaactctaccagtgcttagtaataacaaaaggcagacagactttgggtcggttttattattgttttaaaattccctctaggggctgggcgtggtggctcatgcctgtaatcccaacactttgaggggcgatggggggcgggtgaatcacgaggtcagaagttcgagaccatcctggccaatatggtgaaaccatgtctctgctaaaaacacaaaaattagccgggcttggtggtgcgtgcctgtagtcccagctactcgggaggctgaggcagaagaatcgcttgaacccaggaggtggaggttacagtgagccgaggtggcaccactgcactctagcctgggcaacagagcgagacactgtctcaaaaaaaaaaaattccctctatgcaatgcagtcccttatagcctgcactctatctgaacagctcccaccattctgtccttggtacactggtgaagaggagtgctgaaaaagtcagggtgagggtgggtaggggagaatggtttgaagttttcaaatctatgtggagaaaagtaccaaaatggctcttaaaaaaaaaaaaagaacttttgttcatttgcctgcaaaatgcaccagctactagcagcttttaggctttcctgcaaagccttaagtgagtgaagtgtgactagcaagcccttaaggatttgagttgtttctttttcttttttcttttctttttttttttttttgagttggagtttcgttcctgttggccaggctggagcacaatggcgccatcccagttcactgggacctccacctcctgggttcaagtgattctcctgtctcagcctcccgagtagcagggattataggtgcatgccaccatgcccagctaatttttgtatttttagtagagacggggtttcatcatattggtcaggctggtcttgaactcctcacctcaggtgatctacccgcctctgcctcccaaagtgctgggattacaggtgcgagccaccacacccagccggattttagttgttttctacagtggaaggttttgttttgtttttgtcttttttaaaaaaagttatgccagccactggacctggtggtgagtgcttgtagtcccaggtatttgggaagctgaggtgggaggactgcttgagtccaggaattcaaggcctgcctgggaaacacaggaagaccccatctccaataataataataataataataataataataataataataataatgtgcgggattcttcttagctgtaaatgctgaaatgtatatgttctcaaatgtgcgtgttcctggaccagcctgggtctttgctctagtgtttgctgctatcagttatttcaattgtctttgcttctctcagttatctgacactatgaaccctggatgacttttctttttttttttttttgttgagacagagtctcacactgtcacccaggctggagtgcagtggcgcgatctcggctcactgcaacctccgccagccaggttcaagcgattctcttgcctcagcctcccgagtagctgggattacaggcacgctgtaatttttgtacttttagtggagacggggtttcaccatcttggccaggctggtcttgaactcctgacctcatgctccacccacctcggcctcccaaagtgctgggattacaggcgtgagccaccgcgtctggccaacttttctaattgacttcatgtgaaggtttttgatatgccatagtattataaacaccaatactaattcctcctctctgcatccactctattctttgcaaaatacttttactctgggagatcttttgggcctcacaactccatgagggaatgaagctgctgtgttacctctggcaatgagctcagtctacctcagtggccctaggaagattcaaatcatgttgattctagaggcaaagtcaccttcatttgcccttgagatcagctctgttgactattctatacagaaagcctcatgcagaagttctcactaaggctaattatccctaaaagatcactcaaggaactgagaaatcagtattaaaagctggggagattggcctgggcacactgtttcccttatctgggaaacacttgccttacaggaacattgtaatggctactgggaaaacatagataacatatttctgttgttgggctctcaagccatcagatagtcttatcttgttgattgggagatactcctcatcacagaccactaaagaaaactgcacaggaactgtctgggaccagggcacagtcaggcaggccagtcatgtgagccaactggtcctgtgatctgctctccttcagggtggccaaggagggggcagttgcttgaagttcaccactaagctcaaagaggaaaacatgcaaatggtggcttctcctccatgtcagatgtgatctctctcttctttcctgctacagtaatccggtacaacagtgatctggttcagaaatatcacccttgcttctggatcgatgggcagtatctctgctgctctcagacagccaaaaatgctatgggctgccaaattttggagaacaggaatggaagtaagcaatctgatcgatataatttctttctcctttgactgtttccatcactctcccaagggtctgtcaagcccagggtcatagcataaggttgtacactttgggtgctaaacaaagggtcctgggggagggaggaggcacatgggggctgaaatccagctggtaatctgctctccaagctatgtgacctggcatgcctagctactttttctaacttgcctaaaggcactcaatatggacggcaaagtccctgaccaaacctgtccttggcccctttcctaaagtgcattccatatcatcactggcttcttgttttgcaggcttaaaacctgggagttctcaccggaagacaaaaaagcctcttcccccaacgcctgaggaggaccaggtatacagggaaactgggtgctgccactgcttaaatggaaacttatagtcaagccctaagaacacactagagtcttagaattaccctgggacttggcagtgttaattggtattcttgctaagatgggggatttgttcttctaattaggatttcctcctcgatggaaagatagaaggctctcagcaaccatgtaatccaatcacctgtttagaacaaaacctgatttttttaatgtaaagtttttgttgttgttttgtttttgcttttgtttttgttttgagacggagtctcgctctgtcgcccaggttcgagtgtaatggcatgatctcggctcactgcaacctccgcctcccagattcaagtgattctcctgtctcagcctcctgagtagctgggattacaggcatgcaccaccacgcccagctaatttttgtatttttagtagagatgggggtgtcaccatgttgttcaggctggtctcgaacccgcctcggcctcctaaagtgctgggattacaggcgtgagccaccgtgcccagctggaaagtattttcaaacatacagtaaagttagaagaatttaacacttaataccaacatactcaacacttagcactaacaccacctatcactaacacttcagaagttttttttttttttttggttccttcttgagggctagaaagccctttctcacatattgtaagtaagtagagcaggtattattatactcattttacaaagaaggaaaccaaggttctgagccacttagtagattcacgtacaagtttagtgccaagccggtttcctgaccttagctataaatggtttttgtctagtgagctttaaaaatagtaatgtttgggtcccattcctgagagtttgattttgatgtaattggtctgtgaggaaactgactaggtattggaattggttttttgttttttgtgggtttttttttgagacagtctcactctgtcacccaggctggagtgcagtggcgtggtcttggctcactacaacctccgcctcctggggtcaagttattctcctgcctcagcctcctgagtagctggggctatatgcacacactaccatgcccagctgatttttgcatttttagtagagatggggtttcgtcacgttggccaggctggtctcgaactcctggcctcaactgatccgcccgccttggcctccgaaagtacattggaatttaaaagttccatacatggtctttatatgtgtgcaaggctgagaactcctgcactggtgcttaaaaatggttgttgaatgactgctgagtaatattttagtatgcctgatttgggtgtcttgagtaagccagagagttgggagagaagagaagagtgcttggtatcttgacaaaccctcctaccttttctcctaactacatagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggtgagtccacaccagcccttcctgagcctggtgcctgcccactccctacacgcaaaaagtgctgcggcataattcccgtgatcagcatcctcatcagagactgttcttcccacaccagactgaacatgctctccctccaagtacttcccagcgtgcagctccctatacatggcctctgccacatctctgagcctctgttgttgggcacatataaccaatgcaacatgtgcataagctctgcacctcactggctcactgcctaaccatgcatcagagacatgattgtctttgagggaggtgcatgatacatatacctccatttgagatttgttctgagctcagggacgtgggcatatgaatctgtctcctggaggctggggaggtgctggatgaactgccacattgtttccttcacaggcaggaaggctacattcctagtaactatgtcactgaagcagaagactccatagaaatgtatgagtaagtatgtttatgtcagtccacaatcttccaggaggaactctctctctctatatatatatatatttatttatttatatatattttatatatatttatatatatatataacacacacaagtgtatatatgtatacatatgtatacatacactggtgtatatataggtatattatgtatacatacacaagtgtgtatatatatatatacacttttttctactttcaacatattttttatttcaagatatatattaaaattagtaccatctgaatcaaatgatgccaccacctcaaattagtgtatctgtcttacctttaccccccaaacaccctccatttatgagagctggagaggtcaccatgccctcaaatccagaagaatcacactcaaagaaaaaggagttgacgacctgatgaaagaattaaaatgtcaaactgctactgttgtcctttcctccctaatcatggaagtggattgttctcaagtgccctagtccctgatctcttccctgcaactccctgctgcttgcctttgcctgctactctccatttccatgaatcttcaatgccaacctgggtttgggaaagggatacagtgtgctatgcacatgacagatgctcagtaaatagggtttgagtgagttgactgaatcactgacatggacaagccctggagggtgctgtaacctccaatctgcttatgaccaggagccactcaagcagcactctcccttcacaggtggtattccaaacacatgactcggagtcaggctgagcaactgctaaagcaagaggtaagtgtggaaccactagcacacagcattctccttgcataagtgaggatcttgaactgagggcctgttctgccccctacctttgggcaaggcagtgtcaaagctgccatcgtctgggatcccaattacaccattttttttgtttttgtttttctgagacggactctcggtctgtcacccaggctggagtgcagtggcgtgatctgggctcactgcaacctccgccttctgggttcaagtaattctcctacctcagcctcccaagtagctgggattacaggcacatgccaccacgcccgactaatttttgtatttttagcagagacggggtttcaccatgttggccaggctggtctcgaactcctgacctcaggtgatccgcccacctcggcctcccaaaatgctgggattacaggcatgagccaccatgcccggcctgcaccttttaatattaaaagcaatgaggctgtagctcaagcgtggaacttggcagtaaaatcaggggttgttctattttctctctcaagtttgggcaggtgggatgcaggtgtgagcaccacttcctcctacagacagcttctttttcgttgtttcaggggaaagaaggaggtttcattgtcagagactccagcaaagctggcaaatatacagtgtctgtgtttgctaaatccacagggtgagtgctactattccaaggccctgaggacaaagaacaggggtaccctcctaatagctccttgatgctgtgcccgtcccacttcctctgtctctgaaactcaaaactcatctcacttcacttcctgggttctgttgacctttgtgcccaagttactgactaagcatccacttcttcagggaccctcaaggggtgatacgtcattatgttgtgtgttccacacctcagagccagtattacctggctgagaagcaccttttcagcaccatccctgagctcattaactaccatcagcacaactctgcaggtgagtaccaggggcaactgagaagggagttacagacaccaggataagcaatgcaggacaaggtgataagaggaagaatctgcctcacaggacagtgtgaattcactgtgaaaggaaatccctgtgatactgggtagaagctggtaaagaggtggtcagaggcagacctacacccaacagggactgactctttatttggtgattgatgttcagtgttaagagaagacacaaaagaggctggtgactgattcatcagcaagtattcattgagttcctactgtgtactcagcgatttcctcagttctagaggagaacacgggaacattctgagtcgaggtccttgtcctcaaagaacatacaggttagacaacatcagaagaaagtttataagcactgtaaaatttctaaaaactgagacattagtgagggcatggatatgggggaacagcttcatcaagaaggtaggatgtgagctaagcctgggctgggaggtgggaatatattcagttaggcagtgtatttcaattagtattttctcttttttgtccctgaaaagtattttgtgagaggagaaacctctggaaatatgtgggttcatggaggtcttctgggattcaaaatgtactagaaagatacacaccggaagtgtgaggctttaagtgaggatgtgtgaggcatcccacctcctacaccacaccaacagcatgacctctctctctgtttcaggactcatatccaggctcaaatatccagtgtctcaacaaaacaagaatgcaccttccactgcaggcctgggatacggtaactccttatttctctggggtagggtggactggccagttgcaaaaactacctttgctggccttgccttagggagtgtccttgaggtacactgttctgcagcagctgcctcaaggacgctcaagacagatccaagcaaaagttattcactgattttcttcctctagtggctacgactgggactgcaaaaacatagattcataaagggctttgtcgttgtcttgggtctttttgtcttttatttttaattgtgggaaaattttcagtactatccctgagttcattaactaccatcactaacataatcataaagggatttggggaggttgcttagtctatcttcttgccttatggccaccttgaacctaaaattcccagattcctctaaccaatgaatcccgtttctgagattgacttaagcaaagacagattagtacttctaaaaatttcccttttactagttttcctatttctaccccagtagggatttttgtctattgtaagaattatacattcatgaccccaaagaatcacaccaagactttattgttaggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgtgagttatagcccaaactcaactctcaatctatttgctggagtctaggaattcacacaacaacccactgaggcttaaagatgacttacagtaagagaggtttgggacgagggactgaagtttacctttaactggcggtagtcctaagtgctaagataatagtttctgtgccttagatattggttgagaatagtggtgatcatgggtgtgtaccatctcagtagcatttgggggtagatgtagaaaattaaactttcaagagaaatattctaatttagccttagcgttctttcattcctggacttgtttctttttcaattgatgggctccaaatccctgcttgcttccacattttaagcacttttgagatttagggtgggaaagaggaaaataaacttgctggtgtgaccccttatctgatgctctactcctaggtcagccccttcctccccagcccctttattgctattatgcagagccaaaaggagaagactagttccttgcctttcctgtaggaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggtgggaccttagaaggattggcctaggacaaagggctgatggggtggaagtagcagtggaagatatatcatacatggttgaggggggctgctggtgccatcatttcaattttatctagaaagtactataagttaggcgtgcctctgccccagtgctgagcccatcaaatatctccagcctcagctccatgaagtctgccgtggtgggaatcagagcagtcactcactcccaaccccctaccacccacaagaaaatggtggggtctttcagtggccattctggatttggaacagaagggactgtgcttcccaatgggactgctcctggcatggggccatcatttggttccttcagagtcacatactggggcctgtggatgcatttggcccacatgtgtgggttttttttatgttatataataattagcaaacccttaaaaagaaacatttcgcttaaaaaaaaaaaaaccctggaatttccagcttctcttgaaaatctacaccgtctggaaataccaggtccacattctcacgaaccgcctcctttcctctaggcatgtactctccatttcctgcaatctcgatccacttcacttcactcttacttaacttgcctggcccctgtaagcatcagagtttgcgcccctgtttctttcagtcaggccaaggctcaaattgtcctagtctcactggcagaaaagcagaaagcaaaaaaacttacttctcattctcccttctttgttttttgtttgttttgttttgttttgttttgttttgagatggagtctcgctctgttgcccaggctagagtgcaatggcaccatctcggctcactgcaaactccgcctcccagattcaagcaattctcctgcctcagcctcccaagtagctgggatcacaggcgcccaacaccacgcccagctaatttttgtatttttagtagatggggtatcgccatgttggccaggctggtcttgaactcttgacctcaggtgatccacccacctcggcctcccaaagtgttgggattacaggcgtgagccactgcacccagcctctcccttaattctttcagcatatcagtgagggaatggggtggtgtggaattgcccatgagaatgcaatcgttctgtatgtcctcagtgctttacctaggactacacagcaggttgctttccacgtggtggaaatgaatcaaaatttcttggtggcatcaacagattcctattaggtgggaaggtgtctgtagtcgaaggagatgaagcttccctggcttcattctactggtcagcagaagctttgtgcctttaacctctgtgctggggacggagtctcactggtctctgtttgcactacaggcagctcgaaactgtttggtaaacgatcaaggagttgttaaagtatctgatttcggcctgtccaggtgagtgtggctttttcatctttccctccagaagtaaaaatagcacagtatgaaacatgggtaggtgttacagttttaatcctctccttttcttttttttctcattctagcgttttctgccgatctttctattctttttcttcctctgagttatttaagccacctctttcatccttttgttttattgtcatatccctttccttcctttctccctttatctctacctcctcttttttaaatctatttccccaataccttatcttgatctattaatcctgatgactttactccattcctccttctttcttaatcagtctaattcccagtgacaactgcagataaaaggaagggaaggagaagagcagagaaaggaaaggtggatagagaagaggaagggagtacctactagatcttatttcacttcatccttcttgtaaccatattgtcaatcaggaaagctcaatcagatacaaaaacaggaaattcgttaaaagtaacgtttgtagaagatactagttgaggaggagagacttttgagaaagcctgtgtgtgtttgtgacactcttgtgaccgtgccaagaaaacgtaagcaaatatcaagcctccaaatcctaatgcaacaagtcctgaatcccttgcaggtatgtcctggatgatgaatacacaagctcagtaggctccaaatttccagtccggtggtccccaccggaagtcctgatgtatagcaagttcagcagcaaatctgacatttgggcttttggtaagtggataagattacacagattatacagctcaaaggataagaaatgcaatggggaaaattcacactttgcaacctccacagagatattgttcttgctttcattcttccaatccttggggagtgcttactgtgtgtcagccaccacaggggtttctgaggatgaaaactaaactggacatgatctctgcctttttagaacttaaaccatgttaaggaaaacaattcattcagttttcaacagcttctgaatactgattatgtaccaggcactctgccagaccctataactgcaaagacaaataagatgctgtctctcttctagaggagttaatagtctagtacgaccttgatctccatctagtgtggtcagtactatagcagaaatttgggcaaaatataaaaagcacagagcggggaaccaactgattctaatctttgaggttgatctaggaagactaggacccctgctatccaaaaagactgcaaaccaatttaataatttttttcaccttctaggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgaggtaagtgctttattaggatctcttaaattatttccttgaatctacttgcccatttagctggccattcagccaccaaagactgatagctgcacacattcttttttttcctttttttttttttttaatttgagacaaggtctcgctctttcacccaggttggagtacagtggcgcgatcttggcttactgcaaccttcgcctcccagattcaagcgattctcatgtctcagcctcccaagtagctgggattataggcgtgcaccaccacaccaagctaatttttttttttttttttggtgacacagtcttgctctgtcacccaggctggagtgcagtggcacgattttggctcactgcaacctctgcctcctgggttcaagtgattctcctgccttagcctcccgagtagctgggactacaggcacatgccaccgtgcccagctaatttttgcatttttagtagagacagcatttcaccatgttggccaggcaggtcttgaactcctgacctcaggtgatccacccacctcggcctcccaaagtgctgggattacaggcgtgagccactgagcctggccaattttgtatttttagtagagatggcatttcgccatgttgaccaggctgatctcgaactcctggcctcaagtgatccgcccacctcggcctcccaaagtgctgggattagaggcatcaaccaccacgccaggccttgcacacattctctgaccttggcctgcaacttgatcatctgatggccagaggctttcccaggcccactccgattctcactagagtgtcattagtacactccaatgccagctcagctttagggagtgaggtgttgtggggccatgtcatctagcataagcaggcagccagaggcattcagacaagtgaatgggcattacaaaagaaaagtcatgaaagtttgttcattcctttgtgtgtcattggccctttcttctactttattagctgccaaccgtttctggctgaggtcctaaatgagattttttttttttttttttttgagaccgagtctttctctgtcgcccaggctggagtgcagtggcgtgatctcggctcaccgcaagccccgcctcctgggttcacagcattctcctgcctcagcctctcgagtagctgggactacaggggcccgccaccacgcccggctaattttttgtatttttagtagagacagggtttcaccgtgttagccaagatggtctcgatctcctgaccttgtgatccacccgcctctgcctcccaaagtgctgggattacaggcatgagccacagcgcccggctaaatgagattttttttaaaacctactgcttgaaagggaactaaaacaggtagtgggttttttgtttgctttgttttgttttgctttttaatatggtgcatcgtggggtatgtgggtaggtgtggtattttggaaataaggaaatctgtcctactactattaaactgctttgctcctcttacctcgagttcttcccaagatgccttctctacttttcagtagatccttggcaacctaaatttctagtaggaaataaatgctcaactcttcagagtgtccaacaagtgcatatgtgaatctggagccttcttggtgaggtgaaaagtgggtatctggatccgagcatggctggtttccctcgaacaaatgacagatcacagagaaagtgcagaaagggaggactccttctttcttctgtgtgatgcaggattaagggtgattggctatgctccctcccaatcaggaccttcttactctgctaattaaaaatgatttcagacaggtactttatccacagcctgtttaaaggagtggtcaaaattggatgcatatcagaaaccctaaggagctcttaaaaatgcagattactggctgggcatggtggctcatgcctgtaatcccagcagtttgggaggccaaggcaagcggatcacgtggtcaggagatctagaccattctggccaacatggtgaaaccctgtctctactaaaaatacaaaaattaaccaggcgtggtgatgtgtgcctgtaatctcagctactcaggaggctgaggcaggagaatgacttgaacccaggaggtggaggttgcagtgagccgagatcctgccactgcactctggcctgagtgacagagcgagactgtgtcacaaaaaaaaattcaggtaactgggacttttctccagaaattctgattagctatgcctgaagtggaacccagaaatctctttttaaacttcccaggaaattctgatactcagctaagtttaagaatcactgagtcaaggaatcaagaaattgatgaccattggttctaacagattgagagcattctggcatgaatgttccctgaaccactaaataccaaatacctcgggggcttatgggccatggccatcaaaaagaaccttagtcgtaggccgggcgcggtggctcacgcctgtaatcccagcactttgggaggctgaggcgggggaattaccttaggtcaggaattcgagactagtctgaccaacatggtgaaacccggtctatactaaaaatacgaaaattagctgggcgtgatggcgtgcacctgtaatcccagctacctgggaggctgaggcaggaaaatcgcttgaacctgggaggtggcagtgagctgagctcacaccactgcactccagcctggacaacagggtgagactctgtctcaaaaagaaaaaaaaaaaaaaaccttagtctttttgttaccagtggtaaaaaaaaaaaaaaaaaaaaaaaggtcccaggtactcagaatccctgctcagtaatacagcctgtggttttgaaatattaatcactaaaaattatcacatgggatttctgttctgccaaccacttgaacttgtttggtagccatttttcacttgaggatccaaaataagaatgtgttgtatacagttacataatgaacttgccctcaattttgatcagtgtgattgtcagtttaatttgcaaattgttcttatcacactaataacctgagttactaaagatgaaaagtgcacaaagactttatggagagctgctatttcttttttttttttttttccttttgtaatcgacagggcatgctactgggcatagagcatatatttaataaacatttgctgcttactcattgcatttcccttgaattctggattctagccactctaacactttactttttctttggttttagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtctttggtatctctattaatcatgcagcctccctgaagcgccctatctcagtattccagaaagctgctgtgtagcattagtttggcatattcctacactgagaactcgacaggatcctccaggtttaagccctcttgttaactcctgcctctgaatcaaagatgcattaagcaaaaacagtgcctgtcacagcacgcatgcaatgttatttgaatgaatctgaaagttgggcacaaactgccatagcctcatttccctacgtcgggagaggaaaactccatcaaaaaacgaaagccaggggcccaggatagccaactaatcgacccagtcaactaactgacccagtgcacaactctggtagctcagaaaacgcgggctaatttggaagtggacaggggcggagctgtggggccagcacggaatggatcacgtggtctgaagtaacttccttttctcctttcttttctttttggagtaacatctcaacggcacctcggctctgggctgtaagccctgcgatctcaaggcgcaaggctgggcgcaacggcagggttgcggggttacgggattgcggggtccggggagtggaacccgccgactccgggaacgaagcaccggcgccaaggtgtgggaggcggcggggtggagttggacgcctgcctcgcgccgacgcagtgcactcacgggggcggtcccagaggcagctagctgtggttccggttccgtcgcggagacacgtgaaggtcggtgcggagttcgtctctgcaagcttggtcgccctgggatggattcctcctcctcttcctccgcggcgggtttgggtgcagtggacccgcagttgcagcatttcatcgaggtagagactcaaaagcagcgcttccagcagctggtgcaccagatgactgaactttgttgggtgaggagcctggggctgggacctgaacactgtacctactttccctctgtccttgtaccgcgggactcgcgacaacgtcggggattcggggtggggggcgggcacctggcagcaacccttgattttctcaggttcctgtggcctagccggatgggagaagggtgactccgcttctctggggactgtcattccggacctcggctttgttggtgtagaggactgggtatcaaagaagacttatgccactggacacccagcactttcaggcacccgaggttgaagctgcctagtgctggtcaccaagactgatcggagcccccagtactgggattttatttttggcagcccgagtcccagagagtcagtgaatcagtgaatctgctattcctggactcctcgggatttaccttcattacccagttctaaccctctccgctgaaaaatgagtggctccagcccagtaactataaaagtggtgtaatctcttccaacgtacatacttatttgctttcttgttggattgttgtgtaataccaagccgttttgggtctgaaggttgaggaattgagcctgccctgtgaggggactttggcaaaagggtggaaggtatttgcagcttgccaacaacgtgttctgcttgccaaggacagatctcccttaatgtacacaattcacagaattcagaggccaaggataattttccttggaattagagggtctgaggcttgtgtacatggcagagaataatgaacgaaatttttgaaccacttaacttgaactatatacagtcattggtttccataggccctttcccataaacttacagtattgctggactatgacacctaccagatgcttacttaactctggtctgccttggaccagagtgctttgattcttttttaaaaatatctgtgattcgttactttggggctaggagggcgtgtggttaagtactattgcaagaatctgtaagctgcccggcgcggtggctcatgcctgtaatcccagcactttgggaggcgggtggatcacttgaggtcaggagttcgagaccagtctgggcaacacggcgaagccctgtctctactaaaaatagaaaaaattagctgggcggggtggcacccgcctgtaatcccagctactcaggaagctgaggcacgagaatggcttgaacctggcggaggttacagtgagatcatgccactgcactccagcctgggtgacagagccagactctgtctcaaaaaaaaaaaagaaaagaaaagaaaggaaaaaaaactgtaagctatgatgaaccccttaggaaaatgcattcaattttccattcatcatgacaggattcaagaatctctagcttaagtagacaaggttatagaatctcaagtcatattttttttcttctttggtaggttttagggtaccttgctgaaatgatttatcctttcacccttttattctgtagttaacttaaaggcatttagttcaaacagcattgtggagttaaaaccaaattcattgaaaggttacttcacttatattttgccattttcttgctctggaatatcccagctctgccattttctggccctatgattttgggtaaagtatctctgtgccacagttttcctctttgtaaaatgaggatttataatagtatctattccatagtattgttgtaagaatttaatgtaaggctagagaacattgctatatacttggtcagctgccaaatgtgaactatcagtaacatatcagatattatttttaggtaaagtttttttttctctaagcaacaaaaagggacccctgcccccaaccgtctttttctttccaagttccctttgtgattctgtatcttgtcctgagcaggagaagtgcatggacaagcctgggccaaagttggacagtcgggctgaggcctgttttgtgaactgcgttgagcgcttcattgatacaagccagttcatcttgaatcgactggaacagacccagaaatccaagccagttttctcagaaagcctttctgactgatctcagcattacctctttggaaaaggaaggtagttcaagaaatgaagagctgttgatgggatgattgaagaaacagctatgagaggattggctcccatcttttgttactcttgggacatcctgtcatctgagaatgaacaaagaccaattttttgtgtgtgaagcttaagggtcatatgtttgcttgtattttttaatgctaatcttgtgaaaataattgacaggcgaaagaaaactctatttagatgcatattactgtacatgggactatgcttttctcaaagccccattaactgcttcctataattttgatagtgggaccacatacgtaaaaatctctcatttgtgtggagtcatttctgatttcaggggagatccttgtgtttatcagaaagggcagaagtaggggaagaataatttggtatccttatctagtgtttgattgtcaatgctggagaaaaatatctgtaagagtgtttatacagtacacttcagttatcttgatctccctttcctatatgatgatttgcttaaatatccatattaagtaagtctcaaggtagggtaggcagcctgagagtctagaggcctttagttataaaggaatctagccagtgaacataattcttattactagactgccacaaggaagaaattaacttaccctgtatatcagggtacaaaaaattcagtgatgtgcctaaataagttataaagatttaggccaatcagaagctaacagcagtttcaggtagaggtgcatgcctaatgttagttagtgtagattccatttactgcattcttctgatcactgaaataaaagctatataagattcaactctgtgattgagaaggcatcctattgcagttattatctgcaacccggagagatttagcatgggctgattccaaggttaaaatgtagtcagtcagtctgggtacctgctctgtgtaaggtacagcacagtattccaggggttcctgacctttttgagagaaaagagaacctagagatgagatggggagggaagcggttatgtgctggcagtcaagtccgtgagtatagtagaggttgtattgactggattctcctcttatttcaaatccttgtagactggagtatagacctaaaatggacctacttgttgggagcctctagtgcaaatccatgaaatctggggaaatgaacatctctaaaagcttcaagtccctgtttagattttccccataaaggtgctagaaggactttttttttttttttttttgagacggagtcttgctctgtcgcccaggctggagtgcagcggtgggatctcggctcactgcaacctccacctcccgggttcaagtgattctcctgcctcagcctcctgagtagctgggattacaggcgcacgccaccatgcctggctaatttttgtacttttagtagagacggggtttcaccatgttggtcaggctggtctcaaactcctgacctcatgatctgcccaccttggcctcccaaagtgctgggattacaggcgtgagccaccgcacccagctggaattttttttaaatcattatgaaaacacagttaaacatttaagttcatactctgtgccgttgtttttagtgacaggatttcagcagtgcacagaaacagtccctgcccttgaggagctattggtctagttaggggaggtagacaataaacacataaatatgtcaatgtaataagtgccatggagaaacagcagagtaagggtgttagggaatatttatggagtgtgattattttatataagatggtttgagaaggcctccttgggaaggtggcagtccaacagagacctggatgaactaagcaaccaaaccttgtgggtgttgccgagcacggtggctcacgcctgtaatcccagcactttgggaggccgaggcaggcagaccacgaggtcagaagatcaagaccatcctggctaacatggtgaaaccccatctctgctaagaatacaaaaaaaaaaagagctgggcgtggtggcaggcgcctatagtcccagccacttgggaggctgaggcaggagaatggtgtgaaaccgggaggcagagcttgcagtgagccgagattgtgccactgcactctagcctgggtgacagagcaagactccgtctcaaaacaaacaaacaaacaaaaaaaccccacaaaaccttgtgggtgtctgagacaagaacatttcaggcaggaataacagtaagtccgaaggccccaaggtaggaactgcatgcatgatgccgtggagaacagtcaagaggtcattatagctggagtaaagtgagtgaaagagaatggtaagaaataaggttggagagaccgggtgcggtgggctcatgcctgtaatcccagcactttgggaggccgagatggatggatcacctgaggtcaggagttcaagaccagcctggccaacatggtgaaaccctgtctctgcaaaaaatacaaaaattagccaggtgtggtggcaggtgcctgtaatcccagctacttgggaagctgaggcaggagaaccacttgaacccaggaggcagagattgcagtgagccgctccagcctgggtgagagagtgagactccatctcaaaaaaaaaaaaaaaagaaataaggttggagaaaaacgcatgcaatggatcagggtgacgggtgtgtgtgcactgattatgtggggccttgtaggccatggcaaggactttgggcttttactaagcaaggtggggagccatttgagggattttaacagatgaatgatgtaacataacttaattttaggagggtctggctgctctttgggcaacatcacatggtgaagaagttgtaacagtagcagtagtagtaagaataatggcattttgaaatccaggaaaatgagactttaaaatgcatataccttgtaactatatgtccccgttgacttttttttccctacaaaatttaatgtgaggccaggcacggtggctcacatctataatctcagtactttgggaggctgaagtgggaggattgcttgagcccaggagtttgagaccagcctaggcaacatgccaagaccccatctctacaaaaaatacaaaaattagctgagcatggtggcacatacctgtagtcccagatacatgggaggctgaggcgagaggatcacctgagcctgtggaggtcgaggctgcagtgacccatgatcacgctactgcactccagcctgggtgacagtgagaccttgcctcaaaaataaaaagaaaatgtgttcttaaaacctcaagtcataggaacggttctttagtcttttccttattattatatttattatgttatttattactatattatttagtttttttttttttgagacagagtcccactctgtctccaagccagcggcacgatctcggctcactgcaatctctgcctcctgggttcaagcgattcttctgccttagcctcccgagtagctgggattacaggcacacaccaccacacccagctaatttttatatttttagtagagacggggtttcaccatgttggccaggatggtcttgatctcctgacctcgtgatccacctgcctcggcctcccaaagtgctgggattataggcgtgagccactgcgccccaccttatttagtattaaagtgttctcattacttgtacacacaaatttaaatgtcttagctttacagtattgcttgctcagcgaatatatgtcatgagaaaggtctgtcagattcatacagtaaacttgagcaccaattatgtgttttgacactactgggcacaaagacaatggaaaagaaaaggtgtaacaaatcccctgtctgagattaataagccccaaggcaacaatttgggcttttgtttgttttgtcaatctgagaaatgcagtttcagaactttgataggtggtactgttagccctgatgacattcaaagtcctcatttcaaatattcaaggtagaaaattcaaaactcagttgtaaaacaaaagaattggattagcagacccttttcatgaaatgaaatcttacttagaagcctgttatgtaaagcagaaaagccaagctactctggtggttagtatctggaagccttcctactgttgtgttgtcacccacctgcactgccagtgatgcctaaggctcatcttcaagcttccaggttttaccaagcacactctgaaagtgagtctatgtattagggataacagaaggaaatcaagcaaaaacttgctctttatttacaataaactccataaggaatttgaattctaaagttaacaaatcaatgaactccatgtaaaatagtctttacatggaataatggaaaacaatcgatggtccttttcttaaaaaccaatttttccccattgtaatacctttttttttttttaagatgagatctcgctctgtttccaaggctggagtgcagtcatttccatgtagtatgtacttttcccgagtactgccatgactcacttgccattttcaaggaatagcagcccactgactcaacaccctcacagacacacccaggatcaatactttgtatccttcaatccaatcaggttgacactcattattaaccatcacaaacttctttataaattgttatggaatgagctccaatacatattgttaaagttaaaaagcaagattaaagactaccatttgtgtaaaaagggggggggattaaaatatatgtatgcatatttgcttgaataagcattaattaactcttgaaggatattgttaatattgattgcctctggggaaaagaactgggtggttggggagtaggggtgggagactttttgccatttatcttttctttatgccttttgagttttgaatcatgtgaatgaattacctattcagaaaaatacatattattttaaaaaataacaaaatttctctccatttcagcactataaactctgtactaaaaagtggggatgtgtgatagaaaccacttttaggaataaaaaacttatatttcaactacagtactttcagatatcccctagtctcaaatagattcttttttctttttttaacttttgtaaattattttatttcttccatgatgatttaaatggactttttttcttttttttttttgagacggagttttgctcttgttgcccaggctggagtgcaatggcgtgatcttggctcactgcaacctctgtctcccgggttcatgcgattctcctgcctcagcctcccgagtaactgggattacaggcatgagccaccatgcctggcctgactatcttcaaacaagtacaaatatttcataaataatatctggccatttctagccaattgagtaatttgttgcacaataagccacctcacatctttcagcaagaaatacattaaatttgaataataaagacattacacaatgaattaggacacttttaaaatttgttttaatttttattagggggaggggacagcacacttctacttaatgaagagaaacatttttacagtccagaggtcttttatgtttttgcacctattatgcttgaattcataggggataggttccagcagcccagactcctttccattggttctcacaaagtacacttctctgggtggagcagcctggcacttgagttgaacccaggtacctctctttttggcttcctttttctgatcattttccctcatgcgtttcaggaagctatcttggctcttagagtgcttaatgtactcaatccgcacattaattctcttggcaagaatcttgcccttagcttctttgtttacaacaatgccaacagcatgctggttaacagtgtagacacagttttgccatggtaacacttatgggacattcctttttgaatagtacacattccctcgatgtctctatatgtgtgtgtatatatatattttttctctatatatagaatatatatataaatagatatagaaatatatatagtccataatgaacacatatttttctctctatatatatagaaaagatatatatatatatatatatattttttttttttgagacagagtctcactctgttgtccaggctggagtgcagtagtgagatctcggctcactgcaaattccacctcccaggttccagtgattctcctgcctcagcctcctgagtagctgggactacaggcacgcaccaccacgcccggctaataatatcgtctttcttatagatttgtgtgtacatggccaaaggaacaactctgtgttttctttttttttgagacagagtcttgctctgttgcccaggctggagtgcagtggcgtgatcttggctcactacaacctctacctcctgggttcaagtgattctcctgcctcagcctcccgagtagttgggattacaggcatctgccaccacgcccagctaatttttgcatttttagtagagatggggttttgccatgttggccaggctggtctcgaactcctgacctcaagtgatcctcccacctcagccattttctgaaaggcctagagaacatctatctggtgcctcgcctcttaccctttgtgttcgtcattttggcaaattactgaaagatggcagttccggccaaaaggaagctcttttttaaaaaaagaattatacttcccacacaacactggcatatcaaataggttatttacatctaaggacctctagcagggctgggaatagggtagggtgaatgaggcacttgtttcatgtgcaaaatttaagggggtaccaaaaaattcagttatcaagaggaataattttttgtttgtttggttttttttttgttttgtttgttttttgagacgcagtctcgctctgtcgcctaggctgggatgcagtggcacgttctcagctcactgcaagctctgcctcccgggttcacgccattctcctgcctcagcctcccgagtagctgggactacaggcacccaccaccatgcctggctaatttttttgtattttttagtagagacggggtttcaccgtgttggccaggatggtctcaatctcctgacctcgtgatccgcccacctcgtcctcccaaagtgctggaattacaggcgtgagtcaccacgcctggcctgaggaaagatgttttaatgaaatattttaaaaatcaaattaatgcaaaagtccataatgaacaaaatatcaatatttttaataaagacaggaccagtaacagtgccatactgaaccaaccatatcggagcctgaggcaaaaggcaaaatacaagttccatatacaggcttttatgtattcttgaatagttaactttttcccggaacattacaggagttgaaaaaatattgaaaaatagataaattataactcacagcaattaagtttaaaacatgttatttacaccaaaactagaatttattaaattctactttcttggctttagtggaagcaaacctattgaaattttttttttctttttcttgagatggagtcttgctcagttgcccgggctggagtgcagtggtgtgatctcggctcactgcaacctccgcctccctggttcatgccattctcctgcctcagcctcccgagttgctgggactacaggcgcgtgccaccacacctagctaatttttttattttttagtagagatggggtttcaccatattggccaggctggtcttgaactcctgacattatgatccgcccacctcggcttcccaaagtgctgggattacaggcatgagccactgagcccagccaggaaatattttcattaaaatcagaagcttggatcctttcagactggccaatacagttcctacaattgtgatttttatgaggtgaaaccatctggagctgagaatttttcttttttgaaacggagtctcgctctgtcgcccaggctggagtgcagtggcgcgatctcggctcactgcaagctccacctcctgggttcacgccattctcctgcctcagcctcctgagtagctggtactacaggcgcctgccaccacgcccggctaattttttgtatttttagtagagacggggtttcaccgtgttagccaggatggtctcgatctcctgacctcgtgatccgcccgcctcggcctcccaaagtactgggattacaggcgtgagccaccacgcctggctgagaatttttttatttctaaaaatcaaacagagcctctaagagagaaaacccaaagcaaaacaatcatggatctaaatcagcaagggctggaaggtggtgataactgcaaacaattgaagagttgggatcttgttatgcagaaacaaccagctatgccttgggatcaaaatccagaacaatcaaatggaaattacagtgaagatgaacaaaagggaaagcagaaatggagagaaggaggaggagaagcaggcggaaagagagagggagaaaaagaagaaaatgaaaaggagctggaagatgaacaggaaaataaaaaagggaaagggaaaatgagaaacaatatcccaagaaaagattagtcagcaaatccctcatggacactctgggcaaagctgaagttaaacaggtgccccacaatacaagagagtttatcgatctcatttgaatttggcatgacacataaacagataagtcaacggttttgtaaaaagaggaagaaatgtaataaagaaatgtccaagagaaagcataagaaaaaacataagagatgtggggcgggggagcgggtctctctgagttgccaaggctggtctcaaactcctgccctcgggggatcttcttcccaccttggccttcagaagtgctgtgattacaagcatcagccattgtgcctggctaagacgttttttctttttcctttttattttttatttttttttttttgagacggagtctcgctctgcctcccaggctggagtgcagtggtgcggtctcagctggctgcagcctctgcctcccaggtttaagcggttctcctgcctcagcctcctgagtctagataagaagttttatatgacaccattctctgaaaggataaacaaggacatattgacaattgttaattccgtggggtagaactaaatgaggggagtgcaaaggagtttctaaatatcctatttttacactactgtggtttttaagtttttataatggatgttaattgattttatttcagaaaaaaatcaataaagaaattaccaacctccagaagtgttttgagactgaaagggaaatccattgtagaagttaatgggttcagtgcattctgcaacttgtcagtatatctctaaacatcccttccaggccgggcccggtggctcacggctataatcccgccactttgggaggccgaggctggaagataactcgaggccaggagttcaagaccagcctgaccaacatggtgaaaccccatctctactaaaaatacaaaattagctgggcatggtagcccatgcctgtaatcccagctactcgaggggctgaagcaggagaattgcttgtgccgggaggcggaggttgcagtgagctgagatcatgccattgcactccaacctggacgacgaaagagaaactctgtctctaaataaataaataaacattccctcaaaaaaaaaaatcagaagcttggctgggcacggtggctcatgcctataatcccagcactttgggaggccgaagtgggcggatcacttgaggtcaggagtttgagaccagcctggccaacatggtgaaaccccaactttactaaaaatacaaataattagccgggggtggtggcacatgcttgtaatcctagctgctcgggagtctaagacaggagaatcgcttgaaccttggaggcggaggttgcaaagccgagatggccctattgcagtccagcctgggcgacaagagcgatactccgtctcaaataaataaataaataaataaaaatcacaagcttaggtctaatatatagaatttgggggaagttctagtaatctggtgcaatgtaaatgcgaggcagacatcggagaatctctagaaatgaggaccacaaggtagacatggactacatagttatgccacgctaaggagtttagattttattttgaaggtgatggggaacctctcaaatattttaagcacctaattccagaagattacaatcacgtgagtgctgaagtcaacaaggacaagactggagtagagacttagtcgatttctaaggtagaaatgtaattcccagacagacagactaggttctgaatatgaggagtaagaggaaacaaaagaggatgaccactcaagacttaccataaacaatctgctctttatccatattacattacatcttcttcctgacatgtgtgaaaggaaataagttactctctcttttctaagaagcatgccaagcacctcttatttgtggggcagagttcaccataaaaagttgagaaccgctgggcacggtggctcacacctgtaatctcagaactttgggaggctgaggcgggcggatcacgaggtcaggagatcgagaccatcttagctaacacacggtgaaaccccgtctctactaaaaatacaagaaaattagccagccgtggtggtgagggcttgtagtcccagctacttgggaggctgaggcaggagaatggcgtgaacccgggaggcggagcttgcagtcagctgagatcgtgccactgcactccagcctggtctacagagtgaaactccgtctcaaaaaaaaaacaaaaaacaaaacttgagaaccgttaatcttatcaagattctcatacccatccagaatacacatgcacatgtgtaagatgtatccttctcctcacccccactacagtccatttcaagaaagtcttcttttaagaaactggcaagaaaactggtattctgccaaatatgccaagattcatatatagatagagaggttccccatcaccttcaaaataaaatctaaactccttagcgtggcataattatgtagtccatgtctaccttgtgattctcgtctccagagattcttcaatgtctaccttgcatttaagttgcaccagattactagaacttctcccaaattattctacataaatatgaatgtatatattcatattatatatagtggctggcaggtcgactgttttgtttacttttttaggcaagccaaaatatttaaagataaaatagggcagaaaaaaatccatttaccttcttctatgaaagaaaggaggatgtccttctaaataaaaattctttaagaattcaatctaatattggcatttaagccaatgctgcttgccatcctaaaattattttccttttaaaataatctttgatgtccatttccagtaatatggtagccaaaataacctgaatgaaagtcctcccacactacaaaacacttagaaataccaaatacaatataaaatccttttaaatgtacagctgaacttgcaagtaagtaaaggaaatccccaggggtcaaaacaaagtgcaaaaacccaaaaccagagcattgggtaggagttaaaatgtcagttgttccactaggggtgggggtggggtggggtgcaggttgcttggttatctcattaaataaggtgttcaggtttttttgtttgttttttgtttttttttccataggttatcgggaaacaggtggtatttggttacatgagtaagttctttagtggttcatttgtgagattttggtgcacccatcacccgggcagtatacactgaacccaatttgtagtcttttatacctcactcctttcccaccctttccccctgagtctccaaagtccattgtgtcattcttatgcctttgcatcctcatagcttagctcccacttatgagtgagaacatacaaggtttggttttccattcctgagttacttcactttgaataattgtctccaatcccatccaggtcgctgtgaatgccattaattcattcctttttatgggtgggtagtattccattgtatagatataccacggttaatttatccactggttgattgatgggcatttgggttggttccacgtatttgcaattgcaaattgtgctactataaacgtgtgtgcaagtatcttcttcgtataacgacttcttttcctccgggtagatacccagtagtgggattgctggatcaaatggtagttctactttcagttcttcaaggaatctccacactgttttccatggtggccatacttgtttacattcccaccagcacataaaaatgttccctgttcactgcatccacaccaacatctactgttttctgattttttgattatggccattcttgcaggagtaaggtagtattgcattgcagttttgatttgcatttccccgatcattggtgatgttgagcattttttcatatgcatttgtatatcttcttttgagaattgtcttttcatgtccttagcccactttttgatggaattgtttgtttttatcttgctgatttgtttgagttcattgtagattctggatattattcctttgtcagatgtatagattgtgaagcttttctcccactctgtgggttctctttacactgctgactgttccttttttcgtgcaaaagctctttagtttaagtcccagctatttatctttgtttttattgcatttgcatttgggttcttggtcatgaagttcttgcctaagccaatgtctagaagggtttttctaatgttatcttctagaattttaatagtttcaggtcttagatttaagtccttaatctatcttgagttgatttttgtataaggtgagagatgaagattcagtttcattctctgacatgtggctagccaattatcccagcatcatttgttgaaaagggtgtcctttctccactttatgtttttgtttgctttgttgaagatcagttggatgtaagtatttgggtttgtttccgggttctctattctgtcccattcatctatgtgcctatttttataccagtaccatgctgtttgtctgactatggccttatagtatagcttggaatcaggtaatctgatgcctccagatttgttctttttgcttagttttgctttggctatgtgggctcttttttggttccatatgaattttagaattgttttttctaattctgtgatgaatgatcgtggtattttgatgggaattgcattgaatttgtagattgcttttggaaggatggtcattttcacaatattgattctacccatccgtgagcatgggatgtgtttctatttgcttatgtcatctatgctttctttcagcagtgttttgtagttttccttgtagaggtctttcacctccttggttaggtctattcctaagtattttatcttttttgcagctattgtaaaaggggttgagttcttgatttgattctcagcttggtcgctgttggtatatagaagagctactgatgtgtgtacattaattttgtatctggaaactttgctgtacttttttatcagttctaggagctttctggaggagtctttaggattttctaggtaaacaatcatatcatccacaaacagcgacagtttgacttcctctttaccaattggatgccctttatttctttctcttgtctgactgctctggttagaacttccagtactatgttgaagaggagtagtgagagtgggcatccttgtcttgttccagttctcagagggaatgctttcaccttttcaccattcagtattatgttggctgtgggttcgtcatagatggcttttattacattgaggtatgtcctttgtatgccgattttgctgagagttttaatcataaagggatgctggattttgtcaaatgctttttctgcatctattgagatgatcatgtgatttttgtttttaattctgtttatgtggtgtatcacatgtattaacttgcatatgttaaaccactcctgcatccctggtatgaaaccaacttgaccatggtggattatctttatttttttcttctttttgagacagttttgctcttgttgtccgggctggagtgcaatggtgcgatcttggctcaccgccacctctgccacctgggttcaagcaattctcctgcctcagcctcccgagtagctgggattacaggcatgcgccacaacgcccagctaattttgtatttttggtagagatggggtttctccatgttggtcaggctggtctcgaactcctgaactcaggtgatcggccagccctggactcccaaagtgctgggaattacaggagtgagccaccatgcctggcccctggattatctttttgatatattgttggatttgcttacttgtattttgttaaggacttcagcatctatgttcattagggatattggtctgtagttttgttttttggttatgtgctttcctgcttttggtattagaatgatagtggcttcatagaatgatttagggagggttccctcttcctctatcttgtggaatagtgtcaatacaattcttctttgaatgtctggtagaattctgctgtgaatccgtttggtcctggacttttgttttttgttgttaattttttttttttttttgagacagaggctcgctctgtcacccaggctggagtgcagtggtgcaatctcagcttactgcaacctctgcctcctgggttcaagagattctcctgcctcagcctcctgagtagctgggattacaggcgcgtgccaccacacctggctaatttttttgaatttttagtagagacggggtttcaccatattggccaggctggtcttgaactcctgacctcgtgatccactcgccttggtcttcaaagtatatgctgggattacaggcgtgagccaccacgcctggcccttttttgttttttgagatggagtctcactctttttgcccaggctggagtgcactggctcaatctcagctcactgcaacctccgcctccagggtttaagcaattctcctgcctcagcctcccaagtagctgggattacaggtgcccgccaccacgcccagctaatgtttttgtatttttactagagatggggtttcaccatgtttggccaggctggtcttgaactcctgacctcaggtgatccatctgcctcggcctcccaaagtgctgggattacaggtgtgagccaccacgcccagcccttttcttggtaatttttaaattaccatatcagtctcactgctggttattggtttgttcagagtatctaatgcttcctgatttaagctaggagggttgtatcttcccagaaatttttccatctcttctagattttctagtttaagcatgtaaggtgttcatagtagccttgaatgatcttttgtatttctgtggtgtcagttgtactatcttccctttggtttcttattgagcttgtttggattttctcccttcttttcttggttaatcttgctaatgttctatcaattttatttatcttttcaaagaaccagctttttgtttcatttatcttttgtatttttttgtttgtttgtttcaatttcatttagttctgctctgatcttggttatttcctttcttctgctgggtttgggtttggtttgttcttgtttctctagttccttgaggtgtgaccttagattgtctgtctgtgctctttcagactttgtgatgtaggcttttagggctatgaactttcctcttagcaccgcctttgctgaatcccagaggttttgataggctgtgtcactattgtcattcagttcgaagaattttttaatttccatcttgatttcatttttgagccaatgatcattcaggaacaggttatttaatttcgatgtatttgcatagttttgaagcttccttttgcagttgatttccagttttattccactgtggtctgagagagtgcttgatataatttcattttccttaaatttattgaggcttgctttgtagcctatcatatggtctgtcttggagaaagttccatgcactgttgaatagaatatatattctgaggttgttggatggaatgttctgtaagtatctgttaagtccatttgttccagggtatagtttaaatccgttgtttctttgtttactttctgtcttgatgacctgtctagtgctgtcagtggagtattgaagtcccccactattatcgtgttgaggtctatctcatttcttaggtctattagtaattgttttataaatttgggagttccagtgttagtccttatatgtttaggattgtgatatttgcctgttgaacaaggccttttactgttacataatgtccctctttgtcttttttagttgctgttgctttaaagtttgttttgtctgatataggaatagctactcctggccaggcaccgtggctcacgcctgtaatcccagcactttgggaggctgaggtgggtggatcacaaggtcatgagttcaagaccagcctggccaatatggtgaaaccccgtctctactaaaagtacaaaaattagccaggcatggtggcaagtgcctgtagtcccagctactcaggaggctgaggcaggagaatagcttgaatccaggaggcggaggttgcagtgagctgagattgcaccactgcactccagcctgggtgacagagcgagactccatctcaaaaaacaaaaacaaaaacaatagctgctcctgctcgcttttcatgtccatttgcatgaaatatatttttccacctgtttaccttaagtttatgtgagttcttacgtgttaggtgagtctcttgaaggcagcagatagttggttggtgaattcttttttttttttttaatggaattcttatccattctgcaattctgtatcttttaagtggagcattaagtccatttacattcaatgttagtacagagatgtgaggtaccattccattcatcatgctatttgttgcctgtatagcttgtttttttttctttttgtttttaattttttttttttttaagacagagtttcgctcttgttgcccaggctggagtgcaatggcatcttggctcactgcaacctccgcctcccaggtttaagtgattctcctgcctcagtctcccaagtagctaggattacaggcaagtgccaccatgcccagctaatttttgtatttttagtagagatggggtttcaccatcttggccaggatggtctcgaactcctgacctcgtgattcaccctcctcaccctcccaaagtgctaggattacaggtgtgagtcactgcacccagcctgtatttttgttttattggtcctatgagatttatgctttaaaaagtttctgttttgatgtgtttccaggatttgtttcaatatttagagctccttttagcagttcttgtagtggtggcttggtagtggcaaattctctcagcatttgtctgtctaaaaaaaaaacctatctttccttcatatgtgaagctcagtttcacttgatacaagattcttagccgggcacagtggctcacgcctgtaatcccagcacttagggaggctgaggcaggtggatcacctgaagtcaggagttcgagaccagcctgaccaacacggagaaaccccgtctctactaaaaatacaaaattagttgggcatggtggtgtatgcctgtaatcccagcttctcgggaggctgaagcaggagaatcgtttgaacctgggaggctgaggttgcaatgagccaagatagtgccattgcactccagcctgggcaacaagagtgaaactccgtctcaaaaaaaaaaaaagattcttagctgataattgttttgttcgaggaggctgaagatagggcctcagtcccttctagcttgcaggatttctgctgataaatctgctgttaatctgatagattttcctttataggttacctggtacttttgtctcacagctcttaagattctttccttcatcttaactttagataagctgatgacaatgtgcctaggtgatgatcttctggcaatgaatttcccagatgttctttgtgcttcttgtatttggatgtctaagtttctagaaaggctggggaagttttcctcgataattctcccaaatatgttttccaaacttttagatttctcttcttccccaggaacgccaattattcttaggtttggtcatttaacataatcccacacttcttagaggctttgttcatatttttttattcttttttctttgtctttgttggattgggttaattcgaataccttgtctctgagctctgaatttctttcttctacttgttcgattctatggctgagactttccagagcattttgcattgctataagtgtgtccattgtttcctgaagctttgattgttttttacttatgctgtctatttcattaaagattcctctcttcacttttatttttttttttgagatagagtttcactcttgttgcccaggctggagtgcaatggcgctatctcggctcactgcaacctccgcctcccgggttcaagcgattctcctgcctcagcctcctgagtagctgggactacaggcatgcgccaacacacctggctagttttgtatttttagtagagatggggtttctccatgttggtcaggctggtcttgaacttctgacctcaggtgatccgcccgccttggcctcccaaagtgctgggattacaggcatgagccaccgtgcccgggcttctcttcacttcttgtatcatttttttatttcctcttttttttttttttttgagatggagtctcactctgtcgcccaggctggagtgcagtggcgcaatcttggctcactgcaacctccgcctcccaggttcaagcgattctcctgcctcagcctcccgagtagctgggactaaaggtgtgtgccaccacacccggctaatttttttgtatttttagtagagacgaggtttcactgtgttagccaggatggtctggatctcctgacctcatgatccacccgcctcagcctcccaaagtgctgggattacaggcgtgagccactgtgcctggccaatttttttatttccttacattgggcttcacctttctctggtgcctccctgagtagcttaattagtaacctcccgaattctttttcaggtaaatcaaggatttcttcttggtttggatccattgctggtgagctagtgtgatcttttgggggtgttaaggaaccttgttttttcatattaccagagtcagttttctggttccttctcatttgggtaggctctgtcagagggaaggtccagggctgaaggctgttgttcagatccttttgtcccatggcatgttcccttgatgtaatactctcccccttttcctgtggatgtggctccctaagagctgggctgtagtgattgttacagcttttctggatctagccacccagcaagtctaccaggctccaggttggtactgggggtagtctgcacagagtcctgtgatgtgaaccgtctatgggtctctcagctgtggaaaccagcacctgttctggtggagatggaaagggggtgaaatggactctgttaaggttcttagctttggtggtttaatgcactatttttgtgctggttggcctcctgctgggaggtggcgctttccagagagcatcagctgtgatagtatggggaggaacaggtggtgggcggggccctagaactcccaagagtatatgccctttgtcttcagttaccagggtgggtagggtaggaccactgggttggggcagggctaggtgtgtctgagctcagagtctccttgggcgggttttgctgcagctgctgtgggggatgggggtgaggctcccagatcaatggggttatgatcctagaaggattatggatgtctctactgtgttgtgcaggttgtcagaaaagtgagggaaagccagcagtcacaggcctcacacagctcccacagaatccaaagggctggtctcactcccactgtacccccacccccaccccaccaacagcactgagtgagcagggctgagaacttgccccaggctacccacctcccagctgtgaaagcaagtatggctttccttcttcccccacctgtggagtctgcacaccagattcatgccccaccccccgccgagttctggccagaagacttcttgatcagttcaaactgtttttttgttgtttgtttgtttgtttgtttttgagacggagttttgctcagtcgcccaggctggagtgcagtggcatgatctcggctcactgcaacctccgcttccccggttcaagtgattctcctgcctcaacctcccgagtagctgggattacaggcatgcgccaccacgcctggctaatttttgtatttttagtagagacgaggtttcaccatgttggccaggctggtctcgaactcctgacgtcaggtgatccaccctcctcaccctcccaaagtgctaggattacaggcgtgagccactgcgcccagcctctgttcaaattgttacaaagttcggctggagatttctttctccctgtgaccttttccaagtgcctctggccgccctaccaaaggacccctgtaaggccaggcagaaatggtttgctaggggacccagtgagctcacagggcttttcccgctctttcctctactcctgtatttcactcagtatctaaattgactcagctccaggtaaggtcagaatcttctcccataacctaggccttcagtttccccagtgggggtatgtgttcaggggcagacgatctccctttcccacttccacaatttgggcactcacagtatttggtgtgcctcctgggtcctgcaagagcagtctgcttccttcagagggtctgtgggttctcttgggtttcctgatttattcctgcagtcgttctggagcaaaaattcatgatgcgagcctccacatgctgctctgttcatcgaagttggagctgcaatctagtcttgcctcccgtctgccatgatccaccttcttcttcttctttgtttttatatggaatacttcacggatttgtgcatcatccttgtgcagggaccatgctaatcttctctgcatcattctaattccagtacatgtgctgctgaagcaagcacacgtgcttaggttctgatggcctgtagaggcaggagacagagccttgggcctaagtaaggcaggaggttggaactgaaacacctgtaggaagttgggagtttcaaaggacaacaccttcaataaggttgaactagacaaaaattcattcactagtataggaagacaacctgggctgtaagaaggtagaaaacagggtctccctctgaggcctgctttcacatgggtttgggattcaaaatttataactcctacactgtccaggaaccctccacactaaaaaatgagtacaaagtgtatacgcacttaagagtataactattgttattcctaccaagcagaagcaacataaaacagctctagagagacatatccctcacaagatccccacaagtaaagctgcactgaacacaatttaaaataaaaaattacaaaacacatgaaaaaacaccacaccataatcaaatgtctgaagacacaacacatagaattagaccccgaaatatgcaatctaatacacactataaaattgcttaaaatgattaaagatataattgaaaatgtaagaaaagaacaagacattattttatttttacagatttgaggatacaaatgcagctttgttacatggatatattgtgtagtggtgaagtttgggctttaaagtgtaaccatcactcaaatcatatacgtagaacccattaggtaatttttttttttttttgagacagagtttcgctcttggtgcccaggctggagtgcagtggcgccatcttggctcactgcaatctctgcctcttgggttcaagcgattctcctgtctcagcctcacgagtagctggtattacaggcgtgtgccaccaagcccagctaatttttcgtatttttagtagagacagggtttcatcatgttggccaggctggtctcaaactgctgaactcaggtgatccacccgccttggcctcccaaagtgctgggattacaggcgtgagccactgtgcctgacccattaggtaattttttatcccttacacctcttgcacctcccacctttctgggtctacaatgtctattattccactccagtacactagttttaaaaggccaggtagtattgaaaaagaactctagacatgaaaaaaagttttaaatttaagaactcaatggacatgttaaaccacagattgggcacaattaaagagaaaagtggtaactggaaaaatagatatatagaatgcaacacagagagattaagaaataaaaaatatgaaaagaggtaaagaaacatgcaggacaaattttaaaagtaatattcaaagaagtaatgactgagggtattctagaactgattatttaaaaatgtgaattctcgggccaggcgcagtggctcacgcctgtaatcccagcactttgggaggccgaggcaggtggatcaccaggtcagcagttcaagaccagcctggccaagatggtgaaaccctgtctctactaaaaatacaaaaaaatgagccaggtgtggtggcaggcacctgtaatcccagctactcgggaggctgaggcaggagaattgcttgaacccgggcggcagaggttgcagtgagctgagatcacgccactgcactccagcctgggtgacagactgcaactctgtctcaagaaaaaaaaaaaattaaaattaaaaaaataataaaaatgtgaattctcaaattcagaaactatgagtcctgagcaagataaatacaactaaattcacatttagaccattttattgaatctttagaacatcaaaacgaatgatcctggagataatacttaacattttctatgtgccaggattgttctaaacactgtacccaagagataatcattttaatatattggtatattttcttccagtgttttatcgatgcatgtatatgcacaatacaaaaattcaaaacaaaatcagaataatcctatacataaaaacttgtattctttttttttttgctcaacattttaccataagcattttcctatgttattaagcagcagcaatagctgcaataacagtgtaaatgacaactaacattttagtgttgttgtcaggagtatgggttttgaaatcaaactttctgtgtttgagtcccagttcaccacttactagccatgtggcattgcacaagtgactcatcctctctctgattccatgtcctcagtagtaaaaacctacatcctggggttattgtgagttaccatttacttttttttttttttttttttgagacagagtttcgctttcgtcgcccaggctggagtacaatggtgcaatctcggctcactgcaacctccgcctgccaggttcaagcgattctcctgtctcagcctccccagtagctgggattacaggcgctcaccaccacacgcagctaatttttgtctttttagtagagatggggtttcaccatgttggccaggctggtctcgaactcctgacctcaagtgatccacccgcctcagcctcccaaagtactgggattacaggcgtgagccactgcgcccccagccttgtgagttcctgtttactaagctatctgctgggcactgtgctaaacacatgaataatgctatttaaaaaaaaaaaaaaccagtgggttagaaactgctcttggtcctatttttatagatgagaaaagtggggcttaggaagactcttaggtgatttgcccaaaatcatatggccagtgatggagctttgacttgaattcagatctatccccaaaacctatgctttcgattgttgtgctacactgttcttccatatcattttattttattttattttattttattttattttattttattttatttatttatttagagacggagtctctctctgtcatccaggctggagtgcagtggcacgatctcggctcactacaacctccgcctctcgggatc

SEQ ID NO: 3429 - DNA, 1544 bp, Homo sapiens
  Genbank Accession No. U78095
  unsure (1)..(1535): n = a or c or g or t
gcacgagttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctccttttctcnatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttccagcatgttgctttcaaaaaaaaaaaaaaaaaaa

SEQ ID NO: 3430 - DNA, 4000 bp, Homo sapiens
  Genbank Accession No. U78190
tgttcaagaagcgggcgcgggggcaacacgcgcgcggggacgcagtaagatcacaggctgcaaagaaaacagcactaagcgtcctggaggacgctggagcttcaggatagtgtccttccaggtcgtgggaccgccccctcctccccgcactccaccttcccgcaactggatcactcggcggaagcctcaggtgggccccggggtccaagtccgccgccgggagggcgggggcgggccccgaaccgccgactgcagggcgcgtcacggcagccgctcctgattggcggccacggcggtcacgggcaaggtgccccgggattgacgccgcctgtggccagagccggagtaacgggactcccagctgcgcgtcgcagtcccgacgcgagaagggctggagtcggcgtccagcctagagcccccggtgggagccaggccgggacgcgtgcaccatgccctacctgctcatcagcacccagatccgcatggtgagtaccggccgcctggcgacttggagccgggaccaggccctagggggctgcgactgcaccttcatgcctccctcctgggctgcacccaccggggactggaccgggaacccgcccagacacgcccccttggccggggagagggagtggagaagcgggctcagctcggcttccgggactcagcgagctctggccggcctgaagcctttattgccgcgaaggggcccgggtacgtgcgtcccggcaacagggcgacctccgggcgcttccggctcctgtcctacctgtcggcgggagagacccagggagccctggcctcacgcgcagcacctagtgccctgcacagagccgctccgcaggggaaaaaagggcgaataacctgagagaaagaggtttggaaaagataaggacctgccaaggcgctaaaaccccggtgccaagtccttgacccataaacagcaactagctgcacccttaggcacttccaggaagggctatccctgaagctttagggaaggaagaaaagaaagaacaccctgcttggaaaaaaggaaggcgagaaggggctgtgcagttagaggtgggaacaccatgagttagaagtcacgttcctttctctgggcgcagtttccttatctgtaaaaaggttctgattgcccctcaggagtccccttttagcttcagaaagacatgacgggcagcaaggtgctctctgcccttgctcactgcccagtgctggggtgaaccagcaaagggtacacaacccccttggtgggttcaccacgcaacagagagctcttgcagagccctgggcagcggtttgtgaagcagccatctgctcagctgccaaaatgtggattcctgggtcccttcccagacctcctaaaactctgtctggggcttgggaacccatacttggaaatggccccccaaagtgattcttatttcttaaaagatatggctttattgatatgtaatgtgcataccataaattctttgatttaaagtgtacaattcagtgttgttgtttctttagtgtactcagagttgtgcaaccatcaccataatcagttttagaacatttctaataccccaaaaggaaaccctgtacccactggcagacactcttgatttcccccaagtccctcagccctagataaccactaattacctttctgtggtaatgtgatctgagtctggcttctttcatttacatgtttattttgttttgtttttttgaaatggagtctcactctgtcacccaggctggagtgcagtggtgcaatcatggctcactgcagcctcaaactcctcccacctcaagcgatcctcccacctcagcctcagtagctggaactataggctcgtgatactttgcctggctaaagctgagctttaaggcactagggagggcgcctacattgctcctcctgatcattgatgggctccaccccttcacagcttgtgctcagcccctaagaatccttgctactctctgtagcctttacctgaaccttactcagggctagcaggcaggggaggaaggacaggcaagaccttccacctcctcctggcagccagccaagcagccactgtggcttaccttgcaggaggtgggccccactatggtgggcgatgaacagtcggatccagagctgatgcagcatctgggggcttcaaagagaagagccttgggaaacaacttgtaagtagcagcctccctcagtatcctctccctgccagcccctagacctgcctctgctccctttatacaacctccaagcccagggacagggcccagcatcagagccccctgcctgcatcctggggctctgttctccggaggagttggtcccatctgtagcctctccaacatcccccctctcccccacgaggcttgctctgaaagctttccacatccttactggaaccgcagaaacagagtccgttccctgggtctaggactccactagcagactgttccttgccctgccctctcctaagctggaccccatcaaggacagacaggcacagagagaaaggtttttgtcgtgaggatctgcatgagtcgcaaagctaagccctagaagcagggagcagggagcctgcgtcctacctccagggtggctgctgcctggggacctagccatttcccttggcattcttcctaatgcctccatgtctaaactgtgactactgcttccattcctcctctcacccctggaggcagggagaacccaagctacacaggctctctgaaaagagttgtcagagtgagtgccagttcaaatcggggaaagaggagggctgatcccagcccctgggtcaaggctcggggacagaagccagccccctccctttgccatgaggcacttgcctctccatgcccagcttggggcttgagccctttgtctgcttcatggtctttcagcatcaattaaacctgacagaaggactaccagcactctccatgctagggagtggcgcacagagccaggagctactggggctcagccttgttgctacagaactgcaggacagccagggcagtgaggggcctggaggcttatttttttttgaaatggagtctctgtcgcccaggctggagtgcggtggtgcaatcatggctcactgcagcctcagcctcctcctacctggaagcctgggtggggagcaagcccagggagggcggcagcagggctgtggtcagactaacatggtctaccatctgggacgctggggaacctgattaacccctctgttttctcatctatcaatggccacaacagtggcaccttcactagcttgttgggaagaataaatgagatagctcgtgaagtacctagaaggggaggaggcagggggcgtgcacttaccccagcgcccagcaagcagccagcaagtgtgagtcactacaagagtggccaggctgcctgctgcagacactagctttgtaccaggagcttgctgtgtgcccctcctcaccccccccatcctgtctctttgcagttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccggtgccctggtgctcccagctgccctcctgcttcgggcctgggccgagggccttgtgtaggccatgttcctcgggcagctgccccgggccggagctgggcactccagcggccctggcgcgtggctcctgcatagctagcccaagccaataaagggctgtgatgagtggctgcgcctgtgctctgcttgtg

SEQ ID NO: 3431 - DNA, 3152 bp, Homo sapiens
  Genbank Accession No. U78525
aattccggccgcgtcgacgggagagtcggtagcgcggcggccgcggagccctgcgagtaggcaagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggaggcgccgcatgccttgtacccccaccgtgcaggttgtggccggttttctccgcaggttgaacatggaaataaaagcaaacttgtatggaattcaaaaaaaaaaaaaaaaaaaaaaaaaaaaaaaaaaaaaaaaaaaaaaaaaaaaaaaaaaaaaaaaaaaaaaaaaaaaa

SEQ ID NO: 3432 - DNA, 3327 bp, Homo sapiens
  Genbank Accession No. U78556
cacacctttccaaggacccccaaactctgctccgtgcacgtcaaatgctcctttcccttgtgtccaaccccctacccctctccctaacacccctcttctcaacaagactcagcctctccccgaggtgggtgagcatccttgaggtttcccacccttaactgctgtgtccccggatggagccagagaaatgtggtgggggggccggggcagagtttcaacattgccccccagaaggaggagccagagatggggtctgtccaggaaaacaggatgccggagcccaggagtcgtcagcctagcagttgcctggcctccagatgcctcccaggggagcagatcctagcatgggccccaggggtgaggaagggcctggaaccagaattgtctggaaccctgatctgtaccaactttagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccggtcagtgtgatggttagggtaatggctgtggattagagggtcatgtgggccagggacatcgtggagggaggaacctctgtgaggtcagtgtgggggcaagggtagcgtggagctaggcatttctcccacaatgaccctcttctgccccatgtgaagcgcttgtcctggcatcaccctgggggcagtgatcttctccgctgtggaggcttctatacagccagtgaccctaacaaggaggatatcagagcagtggagttgatgcaccaggctgggcattcagatgttgtcctggtagacactatggatgagctgcccagccttgcagatgtccaacttgcccacctgaggctgagggccctctgcctgcctgattcatctgtagctgaggataaatgctttcagccctggaaggaacacgatggctggactatgtcagggcttgtcttcgaaaggccagtgacatttcagtattagtgacatccagggttcgttctgtaatacttcaaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttttgtgtggctcttctctagaggagcattgacccccctgaatcagctctgtccttggcgggacagtccttccctgctggcagtctcttctcgttggctccctcgacctgctatctcctctgaaagctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcatctcccacaatctctggcctccaggatgagctatcccatcttcaggagttattacggaaaggacaccaagaatatctcctgaggatcactccaagaaaagagatccacataccattctcaatcccactgaaattgctggcattctcaaaggcagggcagagggggatctggggtagagggagggttctgtctaatcttttttttttcttttgtatctgcacttgcagcctcagctttcatacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacac

SEQ ID NO: 3433 - DNA, 1579 bp, Homo sapiens
  Genbank Accession No. U79266
aaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagccaggttcagccccgccccgacccgccgctccccacccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgcgcctggacctggcgctgcagggagcgggcgacgccgaggcagcggtggtgctggaggcggcgctggccacgctgctggccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggtgagtcgggatcctggcggctgggcagagcgtggggacaggagcccaccatgacagtggaggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaaaaaaaaaaaaaaaaaa

SEQ ID NO: 3434 - DNA, 1444 bp, Homo sapiens
  Genbank Accession No. U79294
gagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaaaaaaaaaaaaaa

SEQ ID NO: 3435 - DNA, 1567 bp, Homo sapiens
  Genbank Accession No. U79303
aacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcggtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagtgccagtgagaggaggcggtagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaaaaaaaaaaaaaaaaaaaaaa

SEQ ID NO: 3436 - DNA, 11580 bp, Homo sapiens
  Genbank Accession No. U79716
cacgcgtgggctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgscggcggcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagaagggcggcgtcagctaattacatctttccttgacagctcacaatccaggtttctccagttcacactgagactggggagcaaatctgttctgagcacgtgcagagcccctgatcagcctggtgaaggagttttgctgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcacgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcggtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcagctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagcc

SEQ ID NO: 3437 - DNA, 2793 bp, Homo sapiens
  Genbank Accession No. U79725
ctacccctttgtgagcagtctaggactttgtacacctgttaagtagggagaaggcaggggaggtggctggtttaaggggaacttgagggaagtagggaagactcctcttgggacctttggagtaggtgacacatgagcccagccccagctcacctgccaatccagctgaggagctcacctgccaatccagctgaggctgggcagaggtgggtgagaagagggaaaattgcagggacctccagttgggccaggccagaagctgctgtagctttaaccagacagctcagacctgtctggaggctgccagtgacaggttaggtttagggcagagaagaagcaagaccatggtggggaagatgtggcctgtgttgtggacactctgtgcagtcagggtgaccgtcgatgccatctctgtggaaactccgcaggacgttcttcgggcttcgcagggaaagagtgtcaccctgccctgcacctaccacacttccacctccagtcgagagggacttattcaatgggataagctcctcctcactcatacggaaagggtggtcatctggccgttttcaaacaaaaactacatccatggtgagctttataagaatcgcgtcagcatatccaacaatgctgagcagtccgatgcctccatcaccattgatcagctgaccatggctgacaacggcacctacgagtgttctgtctcgctgatgtcagacctggagggcaacaccaagtcacgtgtccgcctgttggtcctcgtgccaccctccaaaccagaatgcggcatcgagggagagaccataattgggaacaacatccagctgacctgccaatcaaaggagggctcaccaacccctcagtacagctggaagaggtacaacatcctgaatcaggagcagcccctggcccagccagcctcaggtcagcctgtctccctgaagaatatctccacagacacatcgggttactacatctgtacctccagcaatgaggaggggacgcagttctgcaacatcacggtggccgtcagatctccctccatgaacgtggccctgtatgtgggcatcgcggtgggcgtggttgcagccctcattatcattggcatcatcatctactgctgctgctgccgagggaaggacgacaacactgaagacaaggaggatgcaaggccgaaccgggaagcctatgaggagccaccagagcagctaagagaactttccagagagagggaggaggaggatgactacaggcaagaagagcagaggagcactgggcgtgaatccccggaccacctcgaccagtgacaggccagcagcagagggcggcggaggaagggttaggggttcattctcccgcttcctggcctcccttctcctttctaagccctgttctcctgtccctccatcccagacattgatggggacatttcttccccagtgtcagctgtggggaacatggctggcctggtaagggggtccctgtgctgatcctgctgacctcactgtcctgtgaagtaacccctcctggctgtgacacctggtgcgggcctggccctcactcaagaccaggctgcagcctccacttccctcgtagttggcaggagctcctggaagcacagcgctgagcatggggcgctcccactcagaactctccagggaggcgatgccagccttggggggtgggggctgtcctgctcacctgtgtgcccagcacctggaggggcaccaggtggagggtttgcactccacacatctttcttgaatgaatgaaagaataagtgagtatgcttgggccctgcattggcctggcctccagctcccactccctttccaacctcacttcccgtagctgccagtatgttccaaaccctcctgggaaggccacctcccactcctgctgcacaggccctggggagcttttgcccacacactttccatctctgcctgtcaatatcgtacctgtccctccaggcccatctcaaatcacaaggatttctctaaccctatcctaattgtccacatacgtggaaacaatcctgttactctgtcccacgtccaatcatgggccacaaggcacagtcttctgagcgagtgctctcactgtattagagcgccagctccttggggcagggcctgggcctcatggcttttgctttccctgaagccctagtagctggcgcccatcctagtgggcacttaagcttaattggggaaactgctttgattggttgtgccttcccttctctggtctccttgagatgatcgtagacacagggatgattcccacccaaacccacgtattcattcagtgagttaaacacgaattgatttaaagtgaacacacacaagggagcttgcttgcagatggtctgagttcttgtgtcctggtaattcctctccaggccagaataattggcatgtctcctcaacccacatggggttcctggttgttcctgcatcccgatacctcagccctggccctgcccagcccatttgggctctggttttctggtggggctgtcctgctgccctcccacagcctccttctgtttgtcgagcatttcttctactcttgagagctcaggcagcgttagggctgcttaggtctcatggaccagtggctggtctcacccaactgcagtttactattgctatcttttctggatgatcagaaaaataattccataaatctattgtctacttgcgattttttaaaaaatgtatatttttatatatattgttaaatcctttgcttcattccaaatgctttcagtaataataaaattgtgggtgg

SEQ ID NO: 3438 - DNA, 1500 bp, Homo sapiens
  Genbank Accession No. U80226
atggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgttcccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaaggatgtcccagctcatcaccatggcctgcgtgtcctgctccaatgaaaacgaccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaacgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaag

SEQ ID NO: 3439 - DNA, 6608 bp, Homo sapiens
  Genbank Accession No. U81607
ccttcttttaaggagtttgccgcgagcgcgtctccttcattcgcaggctgggcgcgttcgcagtcggctggcggcgaaggaaggcgctctcgggacctcacgggcgcgcgtcttttggctcttgcccctgtccctgcggcttggggaaagcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacggaggttggacagagagactctgaagatgtgagcgaaagagactccgataaagagatggctactaagtcagcggttgttcacgacatcacagatgatgggcaggaggagaaccgaaatatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccaccaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttggaatggatgcagaacctcaggaagccgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagaaggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaggcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggttccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacaaaaaacagagcctcctagatgtaacattcctgatcaaggtacaattctttaaaattcactaatgattgaggtccatatttagtggtactctgaaattggtcactttcctattacacggagtgtgccaaaactaaaaagcattttgaaacatacagaatgttctattgtcattgggaaattttgctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcctttaagaacaatgttgcaacacattcatttggataagttgtgatttgacgactgatttaaataaaatatttgcttcacttaaaaaaaaaaaa

SEQ ID NO: 3440 - DNA, 1578 bp, Homo sapiens
  Genbank Accession No. U82108
gaattcggcacgagccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagaccccccccttcccctcccccttcccctcccccttgggacgcgctctaaataattgcaataaaacaaacctttctctgcaaaaaggaattc

SEQ ID NO: 3441 - DNA, 2116 bp, Homo sapiens
  Genbank Accession No. U82468
agaattcagcggccgctgaattctagcaaaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagctgggcggagggggaggccgcgggaggagccttccccagacccagcccaggcccgggcgccgcagacggtctacgccaggttcctcagggaccccgaggccaagaagcgcgacccccgggaaacctttctggtagcccgtgccccagacgcggaggacgaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccctcagggagcccagccagtgcgaggaagagcccagcagccatgtttctggttggggaagrcagtcctgacaagaaagccctgaagaagaaaggcactcccaaaggcgcgaggaaggaggaagaagaggaggaggaggcagctacggtgataaagaacagcaatcaaaagggcaaagccaaaggaaaaggcaaaaagaaagcgaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcttgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtttcggagttcgcctgcgccgctgtgcccccctcctccccgcgccccagtcaattcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttggca

SEQ ID NO: 3442 - DNA, 1985 bp, Homo sapiens
  Genbank Accession No. U83246
  unsure (1)..(1976): n = a or c or g or t
accaggcaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctntgggccacaacccaacccttctcactctcctcagtgctagcactttgtattttttgatacttttatacttgtttctgcttttgctgctcttgatcccacctttgctcctgacaaccctcattcaataaagaccagtgaagaccaaaaaaaaaaaaaaaaaaaa

SEQ ID NO: 3443 - DNA, 1698 bp, Homo sapiens
  Genbank Accession No. U83461
tcggcacaggagcgaggagacccgagagcagacgcgccctggcgcccgccctgcgcagtcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtacttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagatggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacgtagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgattgactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatgggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaatacattttagtaaatat

SEQ ID NO: 3444 - DNA, 1259 bp, Homo sapiens
  Genbank Accession No. U84569
cggcgcccaagcggccccagcgggctcgcgtcgccccgctctcctcaccgagccgccaatgggctcaggatccgcccctgacgacgcgggccccgcccctggagacacgcaccgcgcagtcgtcacccgcccgggatcaggaggccgggggcgcccgccggtcgggcctgggcggccgccatgaagctgacgcggaagatggttctgacccgagccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccacgcctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtcccaggactccccttctgtggtctggaggttctaggctggcctgggctcttaaagggaggattttgcaggctgtcctccctaataaaagattttcccaaaaaaaaaaa

SEQ ID NO: 3445 - DNA, 1669 bp, Homo sapiens
  Genbank Accession No. U84720
ggcacgagcggcacgagcggcggtagtcagggcagtttctacgcaggcttaaggaggcttcgggctcctgggatttctgtccgcgctcctggcccacgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagccgactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcggccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagccccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgaataaaaaaaaaaaaaaa

SEQ ID NO: 3446 - DNA, 2424 bp, Homo sapiens
  Genbank Accession No. U85193
cctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatggaagcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagaygaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaggaaaagaggaagactggacaaaacaacacaaaggcagaaaggaaagaaactgaagaaagaagataatagaccagcaattgcagcacttacaatcactaattcccttaaggttaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagagatgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagagggcaagtgcaatttattaaatttatattcttaaagggggaattcatggattattaaggtccttcaggcccttggggactctta

SEQ ID NO: 3447 - DNA, 1192 bp, Homo sapiens
  Genbank Accession No. U85625
cggcgactgaccgtggtcgtgggcggacggcggcttgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcag

SEQ ID NO: 3448 - DNA, 2302 bp, Homo sapiens
  Genbank Accession No. U85773
gttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagcagcatagggcattcggtggccagagccgagggtcctcccacacgtgctcacccacccgcagcctaggcaggctctgcatgctatgccaggcatgtgccgtctggacttccacctccagtgccagaaacttccagaaagaaggagaaactcttgtcaagaatggcccagaggaatgcctcgcacaaaaggtcttccccacccacccccagccccctagtctaatacccaccctgatacgtgcaatcatgtagttttggcggaaatttccccatcattctaggatgatacagaaagaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctgctgcttctctgtctccgagaccggagtacttgggaacaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccgcggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtttaaaaaaaaaaaaaaaaa

SEQ ID NO: 3449 - DNA, 570 bp, Homo sapiens
  Genbank Accession No. U86409
tcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatct

SEQ ID NO: 3450 - DNA, 1155 bp, Homo sapiens
  Genbank Accession No. U86529
aagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacaagacggtgcccatcaatctcataaaggataggggccaacagttttctaaggacttccaggcactgaatcctatgaagcaggtgccaaccctgaagattgatggaatcaccattcaccagtcactggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctct

SEQ ID NO: 3451 - DNA, 960 bp, Homo sapiens
  Genbank Accession No. U89606
cccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttg

SEQ ID NO: 3452 - DNA, 1512 bp, Homo sapiens
  Genbank Accession No. U90426
cggaagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaggaggaagagccccaggctcctcaagagagcacaccagctccccctaagaaagacatcaagggatcctacgtttccatccacagctctggcttccgggactttctgctgaagccggagctcctgcgggccatcgtggactgtggcttggagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgatgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccgccctgtgtgcaggaagttcatgcaggatcccatggaggtgtttgtggacgacgagaccaagctcacgctgcacgggctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggggggtcgctttggcaccaaaggcctagccatcacttttgtgtctgacgagaatgatgccaaaatcctcaatcacgtccaggaccggtgtgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaagtgttattatgaaatgaagaagcctcaccca

SEQ ID NO: 3453 - DNA, 2281 bp, Homo sapiens
  Genbank Accession No. U90544
ggacagaaaactccctccttttccaagttagccttatagtctagggcttaaaatactggtttaatggtgaaggtaagtgcttttcttctttttgggtagaaggattattactaacttaccaaaggtccattaaggggagggaacagttttaggagaagtcagagaaaagacattaacagcaacataaggatctccatctggtaatattgcctaattccaaaatgaagagactctctgaaaaagataactgattcaatgaagaccctagggcaaggcttgagaagccactggtaccaatggacactgtggacaatggtcatttctccaaggacgctataaaagactgtcgtagtaaaagagattcagggcacagggaaactccaccacaaagcgtggtaccatttcccacagaagctaaatggacgggaagcctgccaccaggaaaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccagggaatggcatggacaggtcagtttactatttgggcaaagtgggctcctccacttgaacgaagcaagctcaccaccattgcaggatcagggtcagcatttggatccttcatcatcctctgtgtggggggactaatctcacaggccttgagctggccttttatcttctacatctttggtagcactggctgtgtctgctgtctcctatggttcacagtgatttatgatgaccccatgcatcacccgtgcataagtgttagggaaaaggagcacatcctgtcctcactggctcaacagcccagttctcctggacgagctgtccccataaaggcgatggtcacatgcctaccactttgggccattttcctgggttttttcagccatttctggttatgcaccatcatcctaacatacctaccaacgtatatcagtactctgctccatgttaacatcagagatagtggagttctgtcctccctgccttttattgctgctgcaagctgtacaattttaggaggtcagctggcagatttccttttgtccaggaatcttctcagattgatcactgtgcgaaagctcttttcatctcttgatatgcaagtttcctcatgggaatctcaaggggatttgggctcatcgcaggaatcatctcttccactgccactggattcctcatcagtcaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcagaactgtaaagctataatccccagaattaaagtttttattattttttatacattgtaaaacatagacgtttatttatgtgattaaattctattaaaatttacatgctaaaataaaaaaaaaaaaaaa

SEQ ID NO: 3454 - DNA, 1795 bp, Homo sapiens
  Genbank Accession No. U90545
acgcgtccgcccacgcgtccgcccacgcgtccggtcggggccagagcgcaggtgtacctggcggccgtgctggagcacctgaccgccgagatcctggagctggctggcaacccggcccgcgacaagaagacccgcatcatcctgcgccacctgtagctggccattcgcaacggcgaggagcttaacaagctgctgggcgaagtcaccatcgcgcagggcggtgtcctgcccaacattcagggcgtgcttctgccccagaagaccaagagccaccacaaggccaagggtgaaaaccattcactaggagaggagaaacacaatggccaccaagacagagttgagtcccacagcaagggagagcaagaacgcacaagatatgcaagtggatgagacactgatccccaggaaaggtccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccttttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagcggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagatttttttttcctgtggctcttttcaattatgagatcagttcattattttattcagacttttttttgagagaaatgtaagatgaataaaaattcaaataaaatgataactaagaaaaaaaaaaaaaaa

SEQ ID NO: 3455 - DNA, 1991 bp, Homo sapiens
  Genbank Accession No. U90549
cacgcgtccggctagaaacattcttgtggagatctcctgtccacacctccaagaatccctctaagtaaacacctagaagtaaaattgctttacacaataccactgtttgcagagtgctttacaaataaccactgtttccaaaagcaaatacactaattggcacacacacacagcagtacataagggttttgattgctccatatcagctgagcccttgatattgtcagacaacttggttttcctcagtttgatagatatgaaatgttatatcctatgcttttaatatgtacttcttatatatttttaggtgcttattcctcactcatgcttccaagaagtacctgttaacattttttgccatagttttaaaattttcattttgtcctttcctcatggatctataggaatgctttatgtattcaggattctaacattttgtccattatatattttacatatatctttgccaagctggtacttattgttttacttttattatgctatcttttttgatatacacgaattattaacaatatagtcaatttgatttttaacgtttacattggtcagtctttccctttatggtttacgctttttgtgtcttgttaaagacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatggaaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtaaaaaaaaaa

SEQ ID NO: 3456 - DNA, 1666 bp, Homo sapiens
  Genbank Accession No. U90551
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaagcactaaggttgcaaaagcttctcatttcagagagatgccaggatcctaagtgcctgccaaacttaccaattctaaggaataagtggatggatggcattactgattcctacattactgattgattctgcatccacaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaaaaa

SEQ ID NO: 3457 - DNA, 1443 bp, Homo sapiens
  Genbank Accession No. U90904
cttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaaaaaaaaaaaaaaaaaaaaaa

SEQ ID NO: 3458 - DNA, 1303 bp, Homo sapiens
  Genbank Accession No. U90913
cggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctgcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccacccctccccgatgtggtgcgctcaataaaaatgctggaattcaaaaaaaaaaaaaaaaaaaaaaaaaaaaaaaaaaaaaaaaaaa

SEQ ID NO: 3459 - DNA, 4744 bp, Homo sapiens
  Genbank Accession No. U91930
cggggggcccggagcgggatcgcggcacctgccgagcgggtcgccgcgtctgccgcggtccttggaccccgccgccgccctggcctgggagcttgccccgccgcagcggccggcagcgcggcgctccgcgggcggcaggcacgggccccgggccccctcacggcgcccagccgcgggcctcccgaggcaaaagcccgtgggccgccgcgatggccttcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggaaaaaaaaaaaaaaaaaaa

SEQ ID NO: 3460 - DNA, 1223 bp, Homo sapiens
  Genbank Accession No. U93205
ccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccagggggggagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtggggtgagtaggacaacatatttcagtaataaaatacagaataaaaatcaaaaaaaaaaaaaaaaaaaaaaaaaaaaaaaaaa

SEQ ID NO: 3461 - DNA, 9180 bp, Homo sapiens
  Genbank Accession No. U93237
  unsure (1)..(9180): n = a or c or g or t
ctggtcttgaactcctggcctcaagcaatcctcctgcttcagcttcccaaagtgttgtaattacaggcatgagcctggcatgaacttgacactattgagatatactggtcaggtattttgtggaatgtccctcaactctgttttgccagatgttttctcatgattagaggagagttataaattttgaggaaaatccagagaggtgaagaggtgaagtagggcagaaatttaatctgttttatttactgctatataccgagtgtctggaacttggcccatggtaagtaccaaaaatctgttttttttgaatgaataagcaaataaatgagtgaccgtggaaatttagtattatttcaaagtttcaaagcgttgttgatacaggccaggcacagtggctcacacctgtaatcccagcacttttggaggccgaggtaggaggatcacttgaggtcaggagttcgagaccagcctgaccaacatggtgacacccctgtctctactaagtaaaatacaaaaattagccaagtgtggtggcaggcacctgtaatcccggctacttgggaagctgaggcagaagaatcacttgaacctgggaggcagaggttgcagtgagccgagatcaccccactgcactccagcctgagtgacagagcgagactctgtctcaaaacaaataaacaaataactactctttggccgggtaaggtggttcacgcctgtaattttagcactttgggaggctgaggcgggcagatcacttgaggttaggggttcgagaccagtctggccaacatggtgaaaccccatctctacttaaaatacaaaaagttttctgggtgtggtggcggacgcctataatcccagctacttgggacttttttttaagacggaatctcactctgttgcccaggctggagtgcagtggcaagattctggctcactgaagcctccgcctcccaggttcaaggggattccccgcgcctcagcctcccaagtagctgggaatccctgtctctgcaaaaaaaaaaaaaaaaaaaaacaaaaaatatatatatatatatatatgtgtgtgtgtgtgtgtgtgtgtgtgttatatgtatatatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagagtaggcatctttatatgttaacagacactgatacccagctaaagcggctgaacacatttactctctggcagtgtttaaaagtatctgtttttctcatattgttttattttaattttttctggatcaagcaacctgatctttttcctcataacttgccgaccgacccgtgacagcaaaaccggcagaagctcggcgacctcccaccccgagtctgcaggtagtgcccccggactacattttccagaaggcactgcgggcacgcttcctgcctggtcggcctgaagggaagggccaatccctgagtatctcgggaaggaggtgtccggagccgcggacctagagatcccagaagccacagcgcagcggcccggcccgccactatttccaggctctgcggggcaggggtgggcccagactccacttcccggcgggtagtgcgaccctaggggcgggacttcatgtcccagcaggctccgggcggcgtgcgccgcggtgcctagtgtgggatgtaagcgcggaggtgggcgagggggaccgaggccaggactctccttggggtttgggggcttgacctgggtgcgctttctggacagactttacagcccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggtgagcagaggctgaagagggtggggaagcaggggagctgtgcgtgtgtcggggcgggtggaaccttagcggaccctgggaggaggctccccggccgaacctgcccgaccctccctcccccggcttgccttgcaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggtgggaatcttatccatgacccacttcttcaaaaccctccatggtttacagaacccttttaagaactgtaagccttgtgaggttcggcaggtgttattttcctctttgcagttgggaaactgaagcccagagaggggaaatgatatgccaaagtcacacacggcatggcagggctggaagtgaagcctgatcacttggctccaaatcatcaacctcacctctgccccctcagcacccccacccttgccactgaacagctacaggagttctaagcatgagacacagagggcggcagcagatttagggggcaagaagatgaaattgggctgcatttgaggcagttaaacaaaataatggctatgaagatttttttttttttttttttttgagacagggtctcactctgtcccccaggctggagtgcagtggtgtgatcatggctcactgcagcctcagtctccctgggctcagagatcctccaacctcagcctcctgagtagctgagagtacaggcatgcaccgtggtgctggttaattttttgtattttttttgtagagatggtgtctcactatgtggcccagactggtcttgaactcttgggctcaagtgatctgcccgcctcagtctcccaaatgctgggattacaggtgtgagccaccgcaactggtggcctatgaaaattttttttttttttcagacggcgtctcactctgtcgcccaggctggagtgcagtggtgcaatctcggctcactgcaagctctgcctcctgctttcatgccattctcctgcctcctgcctcagcctcctgagtagctgggactacaggagcctgccaccatgcctggctaatttttttttggatttttagtagagacgaggtttcaccatgttagccaggatggtctcgatctcctgacctcgtgatccgcccgccttggcctcccaaagtgctgggattacaggcgtgagccaccgcacctggtcaaaaatgtttgagacagagaaggggcttgacctcaaaaggcttaagagtcagggcttgcaaagagctttgcaccaagcccggttgactggcaatcccatcctggtgtgccatattgagaaggaatcagaggctgcttctcagcttagcaggaaaagagtgcagagataaatgagggttatttgttggtgggtgtatagccagagagtgttggccagcgtcctgtttttgccattcctgttttaacctagtaagtgcagtaaaatggaatccctaaatccatagaatatataatagagttgcagagaaagacgaggtagggccaaaggctgggtcagctacaggatatccagaaaggtatcttgttggacatagagggtgtaaacagggagagagtctttgaacacgtgggagggaagggatggagggatagtgggcaggagaatctgaggttgggtcacaggcttggaaagggagtgggagggagtgtggcccatcactacctggcccctttccccatgttaaagcacagaggaccctctttcattacctcccccttccacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcgggtattgttccctccccccagccttgtccccttcatactgtagtagcccaagccacccaagggactccattttcttgggccacacccctttcttcccatcaccacccacataggaagggaagacagaagagccccttttcctggctgtcattccctgaagcaggcacagggtgggccatcatgagacataatgatctcatccccccctaagagctggctgtacctgaaaggatcatacatgcgctgtgaccgcaagatggaggtggcgttcatggtgtgtgccatcaacccttccattgacctgcacaccgactcgctggagcttctgcagctgcagcaggtgagggctgagccaatggggcaggactgggctaggccagacttgacttgctgtgggaccctgggcaggggcactttcccttcctgagcttcagcttcccctcctggaaaaatgggttagtaattcctggcctggcctttcccagggctcttgggagagtagaattgagatgtgaaattgctttgactccattaaagggctggtcccagaattttggcccttccacatggtgggtggtccctgttggttctgacccccacctctgcccgataggctaaggacccgttctcctccctgttccgtggctcataactctctccttcggctcctagaagctgctctggctgctctatgacctgggacatctggaaaggtcagtagagggaagtggccaggctgcgcctggtgaggccggggggctgggtggcagcctgaattatgatcctttcctaggtaccccatggccttagggaacctggcagatctagaggagctggagcccacccctggccggccagacccactcaccctctaccacaaggtgggggcatctaaggagggtgcagaagggagaccctaacagtggctgaggcaggggccctcatctgggcagatgagaagagaactttgtgtgttggggggtatcgcccatccagtctcactttgtgtcaactgtgtgcagaatcagttcagtcagggctgtctgaggggtgtccagggttccccagcctgggagtggcaggggctgcatttgtcccctcagccctgccttttctgccactgcttactgtccttcctggagtataacagaggtcaaatgtggtaggagcactgaagagggggtgttcacttggtgggtgtaggtggggaggagggccattgggctgggcttgaaagtctttggtgatgtgtagaagagtgtctgagaaagagaagggccctgagctcggagggcaggccccacccctgcagtctgccccaggcctcagccagcagtcctgtagacccagggaggagaccaggtagaagggctggcagcgagtggaggtgggagtggagatggagaggactccctgggatcttcctgtggccccttctgggtgtgccctggtggggcatttgtgccagcagggcagctggggctgcctccctgaggatcctctgcctcacctccatccagggcattgcctcagccaagacctactatcgggatgaacacatctacccctacatgtacctggctggctaccactgtcgcaaccgcaatgtgcgggaagccctgcaggcctgggcggacacggccactgtcatccaggagtgaggatccccctactagggcctgcagcctgtcctttcttcccctccatcagtttccaaccaccctcgtccaggactgaggcctggctcccacgccccatcccctttccatccagtccctaggcagcaaggccaccattacccaggaggtagggaccctgattaaggtgtcacatctttccctccctcccctctcctcctaattttttttttctcagaacagtctcaaatctccaatgtttaaccaccatcatccagcagtgggacttccaccctcggccccatgcccccctcctcattcttgctttcttcctctgggctgacccagacagcatcattttgcagtgaggaccccacctactcccccagcccctgggggctccatcccccgccaggtccctggggctacccccgatggtgagaccccttcagaccctacagagaccccactgctctcacagctacaactactgccgggaagacgaggagatctacaaggagttctttgaagtagccaatgatgtcatccccaacctgctgaaggaggcagccagcttgctggaggcgggcgaggagcggccgggggagcaaagccaggtgaaaggctggagctccagcctgtgtccagcctcccacctggacagggctcccttccacagggccatgggggctgcatgtacgggattagggatggcaggaggaaggtggccctgagcagacagctatgttcccttttgctataactgaggtcctgggcccacgttggacgggactgaaggtattttagaggtttctaccctgtgccttcagtttcatggccagactccctccctcagctgaggggtggaggtagggatggtacgtcctggctatggattggctttataaaaggaaagaggttctaagaatgttcccaacctatgcttaccttttctggagccaggggtctttgcctaggtggggggcctggcctgtgccctctgctaaggggtgagtaagagactgatctgtgccctcccttccccctcgtccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgagggacagctgcacagaggtctgggcactacaggtggtgacagcagccacgggcttgtcagacttttctggcccaggggcagcatctgcccatccccttcggtgccgatgggactgagaccccctgggtgggatgggatggccagagcagggtcctggagttccagccactggccggcaaccttgctctcaccttgctctccccactggcccaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaagggagcacaggtcccacctccagcccggggagcctaggaccactcagcccctaggagtatatttccgcacttcagaattccatatcttgcgaatccaagctccctgccccaaataacttcagtcctgcttccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagaggggttaggagtgggtgacaagagcctgatctcttcctgttttgtacatagatttatttttcagttccaagaaagatgaatacattttgttaaaaaaaatataaagcgcaagtccatgtttatctgggaaattggggatggggcggggagtggagcgccccttcttccctttgtcttctggctcccgggactttgcgctccctacctgtggagcgcgagcgacagtggcggcggaaggacgtaggctccgccccggccttggggcttcccccgcgccgccgagggcccgtcccgcgggcgcctcctcccggactggcggtggggcatcccngggcgcggccccgcccccgggcttcagccccgcccccgcggcttcagagccacgggcgcccgccccg

SEQ ID NO: 3462 - DNA, 1000 bp, Homo sapiens
  Genbank Accession No. U93868
cgaggtggacgggcggcagtcaagcgccggcgttctctgccatcaccctttccttgccggccggcacttcggctgcagagttttgcccacgcttcgagacttagggagcagtgcctttcagaatttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtaccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtataccaggaagaatggataccagattggagaagacttccaagagagatgatgccaagaaataaatgtaaaaaagcaggcccaaaacccaaaaaggcaaaagacgcaggcaaaggcacaccactcactaatactgaagatgtgttgaaaaaaatggtggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggaaaatgactacattaattcatactttgaagatggagatgattttggcgcagacgtgatgacaacatggatgaggcaacctattaggcatgaaatttttcaaaaaatatttttatgatgcagcttctgaacatttggacagacttgatttgtattttatttctgataaggaataagatcttgtttctgttgttttggacaaaatgttgttaccaaaatatcaaaaccactttgagtttacatacagttacctt

SEQ ID NO: 3463 - DNA, 38374 bp, Homo sapiens
  Genbank Accession No. U95090
gatctcactctgttgcccgggctggtgtgcagtggcaagatcatagctcactccagcctccacctccagggctcaagccaacctcctgcctcagcctcccaagtagctgggactacaagcacaggccacccaccacacctagctaatttttttttttttttttaagatggagtcctgctctgtcgccaggctggagtgcagtggcacgatcttggctcactgcaacctccatctcccaggttcaagtgattctcctgcctcagcctcccaagtagctgggattacaggcgagtgccaccacgcctggctaatttttgtatttttagtaaagacagggtttcaccatgttgggcaggatggtttcgatctcttgacctcgtgatccgccggcctcagcctcccaaagtgctgggattacaggtgtgagccacagcacctggctagctaatttctttctttcttttttttttttttttttttttgagagataatggggtttcactatgttgcccaggctggtctcaaactcctgacctcaagcaatccacctgccttggtctcccaaagtgctgggattacaggcatgagtcactgcacctagtttcattcaatgcttattaactgagagaatggcttggctctttcttctgtccctccctcgccaagtggcctgggccgagccccttgacttcagtgccttggtgtctgctccccatgtgtgcccttcctttaggcatcccctgggatgaagaaagttctgcatcagtcactggccagacccaacccaggatggtctgcctcagaggtgagggaggcttccttagtcctccgtcaatgccctggctatgctcaatgggtgtctaacgatcttttttttttttttcttttctttttttttttttttgagactgagtctcactctgttgcccaggctggagtgcagtggcgtgatctcagctcactgcaagctctgcctcctggattcatgccattctcttgcctcagcctcccgagtagctgggactacaggcgcctgccaccacgcccggctattttttgtatttttagcagagacggggtttcaccatgttagctaggatggtctcgatctcctgacctcgttatccacacgcctcggcctcccaaactgctgggattacaggcgtgagccaccgtgcccggcctctttttcttttcttttctttttttttttttaaacacagtctcttgctgtcacccagactggagagcagtggtgcagtcataggtcactgcagcctcaaacccctgggctcaagtgatcctcctgcctcagcctcccgagctgggaccacaggcacgcaccaccatgccctactgatttaattttttgtagagaaagaatattgctatgttgcccaggctggtcttgaactcctagactgaagcacgcctcccacctcggcctcccaaagcgctgggagtataggcgagagctaccactcccagcctaacgatctctcttgaactgcaaaacccctagcttgggctggctgaggtcaagatgagcccttccccaaggaggcggcgtcagtgcaggacagcagcttaggcagcacctaaggacttttattgaccacatgaccccctcaggggtgctagtggggtatccttcggcatcctggcagcagccgccgccacagttcttggctgagcagctcctgttccctgcgggcaccctgaagcacgctccggttctcctgggccctccggatcaggtaggggattacctcctccaaggagccatagggaatggacttatacactacatagccggcctgccctgcagggagagtgggttttgttttttcgtttttggtgtttttctgagacagagtctcgctctgttgcccaggctggagtgcagtggtgcaatctcagctcactgcaagctctgcctccaggttcaagcgattctcatgcctcagcctccagaatggctgggattataggcgcttgccacgacgcccggctcatttttgtatttttagtagagatggggtttcaccatgttggccaggctggtctcgaactcctgacctcaagttatcctcctgctttggcctcccaaagtgctgggattacaggcgtgagccaccatgcccagcctggagtgttgacagggtatgggcttgggctggggggacactccccagtccccacctggaacagagacttctgtttctgagaacatggcagattaagtgagttggataaaatttctaactgaaaaagctaaaagtcctggagcaaacttttttttttctctcttagacagggtctagccctgtggcccaggctggagtgcagtggtgtgatcacgactcactgctgctttgacctcccaggctcaaacaatcctcccacctcagcctcctgaatagctgggaccacaggcatgcacctccacgcccagctaactgtttttattttatctcaattgattaattaattaattaattaattttgagacagagtcttggtctgtcgccctggctggagggcagtggcacaatctcagcacactgaccaacctggccaacatggtgaaaccccgtctctactaaaaatacaaaaattggctgggcatggtggtgcgtgcctataatcccggctactggggaggcggaggcaggagaatcacttgaacccaggaggcggaggttgaagtgagctgagatcgtgccactgcactcaagtctgggcgacagagccagactctgtctcaaaaacaaaataaataagctgggcgtggtggctcacgcctgtaatcccagcaactctgggaggccaaggcaggcagatcacctgaggtcaggagtttgagaccagcctggcaaacatggtaagaccccatctctactaaaaatacaaaaattagctgggcgtggtggcagccgtctgtaatcccagctacttgggaggctgaggcaggagaatcgcttgaacctgggaggcaaaggttgcagtgagccaagatggcaccactggactcctgcctgggtaacagagcaagactctgtctcaaaataaataaataaataaaataaaataaaagagaaaatgagaacccagagagagaagagacacacagcaagccacttctgccccaaaagcaaaaccgaggtgctatctgatgaattcacagagttgcggggggacattgagtcagtcttcaagcctgaggtgagagttataagggagaacttccccaagttaagctggaacccaaaaatctacacccttagagtaagagttaataaaaagtcaaccctgcaaccttcccccagtcccaggaaatggtcttggccataaacagatcaaggaagaaaacagaaaaatccacctctgcgaagttggggctatgggttaacccccttatgtatttgcagctcaaatttgtgccagtggggtgtttcaagaaacctcaagctatgaatttaggataaagtgatttcgttctgcttagcacctggcagaaggaaacattaattacctggtgtcaggccctgaggagcagcacagtaaagataacaaaacacacaagaaataatacaccatgatcaagaaccagcagaaatgacagacggcagacacagagacacagccttggaaggcccacagacactggaatgacagatctctctggaaggatctggaggctgggccttggttgggaataggagaagggctctggctgggagggagtaaggcctggggcttgatgggggtgggggagccattcacatacccagtgctagagagacgtggtcacacatgcccagaagttgtccgaaacagacagtcccatccagaggaatgcccagctcccacatgctacagaaaaggccacatcatcagtccagactgtggctgcatctacagcttaaagtcagccactatgcacccatatggcggctccagtaattcaaacattgaagtatttccaaactcaatgatacataataaccagtcctttgcattccttgaaggtcccccagtgactcccagccagttccctggagccctcagacctcctcatgccccagcaaataaggggcaacgtcttgtccatctgggacctataaggacttacaggtatagcaggggttaatgtgtttgtttgtttgtttgttttaagaggtagggacttgctttgttacccaggctggagtgcagtggctcaagcactgctcactgcagtctcaacctcttgggctcaagtgatccttccacctccggaatagctgggactacaggtgtgcgccaccacacccagctgtttttttttttttaatttgttgtagaaatggggtcttgctgtgttgcccaggctggtctcaaacaatcctccaccttcgcctcccaaagtgttgggattataggcatgtgccaaccatgcctggctataaatatttttaaaattctccccagaacacctctgtccatctctggcatttgagcaaaggagaggaagggagggcccttttgtgggcacctatttcccgcccatccctccacctcataccgcttggttgcctggcgaacagattcctcattgtgggaagccaccatgaggtggcacatggggccatggcgggccacgtgcgtcagcatcagttccaggcagcggctgtaactgaagggagatgctctgttcagctcacctggtgagcgagggtcaggccccagcgactggggtgggtggggtgctcctaagcaaggggtctctggaaccagtactctgttccatctgcaccagttgtaagggacatcacttctctgagccactttcatcttctggggttttttgggggttttgtttgtttgtttttgagatggagtcactctgttgcccaggctggaatgcagtggcatgatctcagctcactgcaacctccacctcccaggttcaagggattctcctgcctcagcctcccgagcagctgggattacaggcgtgcaccatcacacccggctaatttttgtatttttagtagagacggagtttcgccatgttgcccaggctggactcgaactcctgacctcaggtgatctgcccgcctcagcctcccagagtgctgggattacaggcgtgagccaccgcacccggccccatgttaatctcttgtcactgtgagtttccgagcaacactgttgtgaggatggagtgagataagggggatatgaagtctttgggacagtggcggcggtctcacaggagagggtcgcatcacatgcacaagatgacatttccccaaggttatcactgctgcattgtcaacagaacatcactagcaacagcccaaatgtccataaatggggaactggctaaggaaattgtggtacagagaagatagtgctctatcgcgcaactgtgaaaaggaaggaagacactgtctgggtactgatatggaagaggaaatagattggcaaacaccttgcaagcatgctgcaggccacgggccacgctatgtatttcacatcctctgtgggtcttccctatcgccccccagacctgttttctacccttctctgcccctcaggaagctgacacttttgccccacatcccccatggagtcatgtgcaggaaggagtgtgggtgtctcacctcggcccctccctgctcaccctgactgtgttctgtgtgtggccacagctccctaaggtggcccctctccttcaactacagcataggggtcaaaatagcttcctaatagcttccctgactttgcccacacttccttttcgttttgtgttttttagagactgggtctcactctgttgcccaggttggagtgcagtggcgtgatctcggctcacggaatcctccaactcctgggctcaagcgatcctcccaccttgggctcccaaagtgctgggattacaggtgtgaggccctgcacctggcccctgacacttctataaacagcctcttcaccacatttcctttagttaaaaccctttgtgcagaattctgtttgctttggagaaagctaatcactcatctaattcccacatcaactctgggaggcagatgttcttattccattttaacagagtggggagactgaagctgagaggggttctatctcttgtccccaggtcacacagctagaggtggccaggctgggatttgaactcaggctgtctgatgctccagagcccaggctccttatcggtaggctagtctgcctttaaaatgcacagttgtggctggacatgctggcttacgcctataatcccagcacttggggaggccaaggcaggagggctgcttcagcctaggagttcaagactagcctgggcaacatagggagaccccgtgtctacaaaaataaaaaaatgtgttgggtatggtggtgtgcgctggtggtcttagctactggggagactgaggtgggaggatggcttgggcctggggagtcaaggctgcagtgagccaagatcgcaccactgcactccagcctgggcgacagagtgagaccctgtctcaaaaataacttaaaaaacaaatgaaaaaagccaaatatacaagggcacatattgtatgattccatttataagattgtctagaataggcaaatccacagagacaaaaagtaggttagtggtttccaggggctgaggggaggagggaacagaaggcagctgactgctcattggtatgaggttactttttggggtgatgaaaatattgtggaatcaaagagtggtgatggttgcacaattttgggaatatactaaactccactgaattgtacatgttaaaattgtgaattctatgatacgtgaattatatttcaatatttaaaataatagtgcaaattattattattattttgagatggagtctcactctgtcgcccaggctggagtgtagtggctcaatcttggctcactacaacctttgcctcctgggttcaagtgattctccttcctcagcctcccaagtagctgggattaccagtgcaagccaccacacccggctaatttttgtatttttagtagagacagggtttcaccatgtttgtcaggctggtctcaaactcctgacctcaggtgatctgcctgcctcagcctcccaaagtgccgggattacaagcgtgagccaccatgcccggccataattttttgtgtttaatgttttttacagatggggtcttgctatgttgtgcagattgggctcaaacccctgggctcaagcaatcttcctgcctcagcctcccaagtagttgggatgacaggtgcacaccactgtgcctggcttggtgccagttaagctgatggtacacaaacgtgccctggagcccctgcagatcttggacatgagcctggattccaagcgtggctaggccacctgctctgtagcctggctgagtccctgtggcccccagagaaggtaccaagaagtaaagatctaaggaggtgagggatggggccatgccactgtctgcagtgggaatgtcccaggcagtggaaacaggatgtgccaagcccctgggtaacatggaggaggccagtgtggctgtagtggagtgagggagaggaagagagggagggaaagttagggaagtgacagggagcatgtggggcttagaggccactgtaaggatttctttttgttttgttttgtttgtttgtttgtttgtttgtttgttttgagacagattctcgctctgctgcccaggctgaagtgcagtggtgcagtcatggctcactgcagccttgaactcctggcctcaagtgatcctcccacctcagcctcctaagtggctggaaccacaggcatgtgctaccacacctgactatttttaaaattttttagagatggggtctccctgtgttgcccaggctggtctccaactcctgctctcaagtgaatctctagcctcagcctcccaaagcactgggattacaggtatgagccactgcacccaaccactaggtgttattatttcctgcagaggccagctggcccgggcctacctctgactggtggcctcatagtcaggctgagtggggtcttccatcccatggagctgggccaccgctctctccttgtccagatatgcacctcgtaccagcttcactccgaaggccaggccggccctgtgcgcagcctctgcatccctccccagccgctcgaatgtgtcctatagggcacgcaggcaggttctggtaggtcagggtgtggggaccccagcctgtacctcctggaacacactgcacacctttagacaggcctggtaggtgttccacacccagggcccgccttcacccgggctgttccagcgcacagccagggcagccaccagcagcgagagcgcagggttcagtgaggtgtactccgcatccaccaggagccgcacgtgctgggcccgggcatactgatggcgacagagacgacggtcagggccccgggtgtccagcaggggcagtggagccagatcccagcaggaggggttacctgtgccacccgatgcaggcggctgagggaggcccggaggtgctggttccagcaggaggggttacctgtgccacccaatgcaggcggcagagggaggcccggaggtgctggttccagcaggaggggttacctgtgccacccgatgcaggcggctgagggaggcccggaggtgctggttctgctcagcattgaggcaggagacctggaggttctagggggcagcaggggaagtggggaaaagcttataagttgctagaaatctaaaaatgagcaatatcagttaggtactatttattgagggggttatgagcctagaatcagggctcgaatccaggcttcaccacctactgtgtgaccttgggcaagttatgtaacctttctgggcctcagtttttgtttgtttgttttttgaaacagagtcttgctctgttgcccaggctggagtgcagtggcatgatctcagctcactgcaacctctgcctcctgggttcaagtgattctcctgcttcagcctcccgagtagctgggattacaggcgcccgccaccatgcccggctaatatttgtacttttagtagagacagggtttaaccatgttggccaggctggtctcgaactcctgacctcaagtgatctgcccacatcggcctcccaaagtgctgggattacaggtgtgagccaccgtgctcagccctccctgctactctttgaacacgagggcaccttcccacctccagccctttacctgctcccatgtttccttcaagtatttgctctaatgtcactttctcaacatggttttcccacctatacattggcaacttcttttcctcttcctcagccttattttcccttacttgttacgtactgacttttgttttgctgagacggggtcttgctgtgttgcccaggctggaatgcagtggcacgatcatggctcactgcagcctccacctccccagctcaagcaatcctcctgcttcagccttccaagtacctagtaccacaggcacccaccaccatgccgggctaattctttactatttgtagagtcaaggtcttcctatgttgcccaggctggtctcagtctcctggactcaagcgatcctcccacctcagccttccaaagtgctgggattctgactttggttttaattattgtctcttgcccctgacttgcaagtaagtgcctcgaggtcagggattttgccttcatgcttcctcggcccctagcaccgtgtctggaacaagatagatgttcagcaaacacttcgggagtggatatgcttgtaacatggaaataagaaccgtttctaactcacagtcttatgcagattcatctggctgaatgtgagctgctggtgactccagggagtctggctgggttcaaagaagttgggaaatggaagaaagaggaacaggtggggctgaaagctttattatatccaacagggtcgatacagatgacataggcctgggcttgctcatggaatcccacctggaggcaggttgggctggaagctgcaaccttccgcatggtggggagaatgctgcctcctggagaagggaagacctggaggcagcagcctggtttcctcctcccctgtcagaggattgtctcctgcttgacttggggcgtagtcttaggccctcagggagctatttcagacacccaccaaatatttaactcatttaatatttaccactctctaatgtaccaactgttattatccccccattttctagatggggaaactgaggcacagagcagggaagtcacttgtcaaaagtcacacagctaactcagggcagacctgaggtttaaacctcagcctttccagagcctgggtctttctctcttttctccctccctccctccttccctcccttccttccttccttcttttttttttttttttgagatagatctcactctgtctcccaggcaagagtgcagtggtgcaagttcaagtgattcccctgcctcagcctcctgattaactggggctacaggcacgtgccaccacttctggataagttttatatttttagtagagatggggtttcaccatgttgcccaggctggtctcaaactcctgacctcaagtgatccagccccacttagcctcccaaagtgctgggattacaggtgtgagctacagcacctggcccttttttctttctttctttatttctttcttccttccttccttccttcctttccttccttccttccttcctccctccctctctttctttcttcgctctcaaacttgccagctcaagcaatcctcccaccttagcctcccaagtagccaggattacaggtgcctgccaccacacccagctaatttaaaggaattttttgtagagatgagggtttactatattactcaggttggtattgacctcctgggctcaagcgaccctcctgccttagcctccacaccaggtgtgcaccagcacacaggctgattttttaatttttttgtagagatgagatctcactatgttgcccaggcaggtctcaaactcctgggctcaagtgagcctccaatttcagcctcccaaaatgcagattacaggcatgaggcactgcacccagcctgttttaatccttaaaaccactgagaagttgctgtcactctccctacaggaataaactaaagctcatgaagaggtgaactccttactctccaaagctgattttctgaaccatgaaatcttgtttctatgtgttctctgacacactttaaaaattacaaataaggccaggtacagtggctcatgcctgtaatcccagcactttgggaggccgaggcacgtggatcacgaggtcaggagttaaagactagcctggccaacatagtgaaaccccatctctactaaaaatacaaaacttagctgggtgtggtggtgtgcgcctgtagccccagctactcaggaggctggggcaggagaatcgtttgaacccgggaggcggaggttgcagtgagccgagatcgcaccactgcactccagcctgggcaacagagccagatgccgcttcaaaaaaaaaaaaaaaaaaaaaaaaaaacgctgggcgtggtggctcacgcctgtaatcccagcactttgggaggctgaggcgggcgtttcacctggggtcaggagttcaagaccagcctggccaacatggtgaagcctcatccctactaaaaatacaaaaattagccaggtgtaatggcaggcgcttgtaatcccagctactcgggaggctgaagcaggagaacccgggaggcggaggtcgcagtgagcagagattgcgccactgcactccagcctgggcaacagagcaagactctgtcttaaaataataataataataataataataataataaataaatagataaacaaataaaaattacaaataaaaaaaggttagaaaaagaaacatcagcatgtccactatagcattgtttgggagggtggagacacagaggccacccaggggttcaccccaggagaggtaaaccatgcagcagctagaatcaactattggaaacagtgggggccgggcatggtggctcagcccataatcccaacaatttgggagggtgaggcaagaagaatttttttttttttttttgagacggagtcttactctgtcaccaggctggagtgcagtggcacgatctcggtttactgcaacctccgcctcccggttcaagcgattctcctgcctcagcctcccaagtaactgggactacaggtgtgtgccaccacgtccagataatttttgtatttctagtagagacggagttttaccatgttggccaggctggtcttgaactcctgacctccagtaatccatccgcctcagcctcccaaagtgctgggattacaggcgtgagccactgcccccggccatgttctaaatcttgatagggatttggattgctcaagtgtgtgtattggttaaggttcatcaaagggcacatttacaatgtgtgtagttcattgttttaccttgaaagaaaaaaagtactgcgaataattattgggctctaattaatgagcccattattcatatcctgaagcatttagggggaaaacatgtctgcaatttactttgaaatgcaccaaaaaataagatggattgatggatggatagaggaatagagggatagatatgatttaaagtgagtatagttaaaggtggcgggggcatggatgttcatgtacaattctttttacttttctgtatatttgaaaatttttataatagaatattggggaaaatatgccccccacgaatggtatacacctggcaaaacaaaatcatagaaacaaaaagatatgcattatacaagacggcaggctgggtgtggtggctcacacctataatcccagaactttggggggctgaggctgggggattgcttgaggccatgagttagagaccaccctgtgcaatacagtaagacaaagagaaagagagagagagagagagaggagggaggagagagaaggaaggaaggaaggaataaaggaaggaaggaaggaagggagggagggagggaggggagagaaggaaaaagaaaagaaggaaggaaggagagagagcaaaagaggaagaggaaggaaggagagagagagaaagaaagaaaaaaagatggagtagggttgaaagagaatgtggagataaaaaggaattaatgattgaatgaacaaactaagaccccattggcctaatcagaacttacacccagccagctcacacccatgcagctgtgttgactgagaacacactgatgtacctccttctaattgataaacagcttctatcccaatccctcctctgagagcctccagcctccaggctcctccctgagaacccagatgaccctgattccatccatttcaaccatgcctgggagctacagctgcacttctgctggctgttccaagcctggaggtggccgtagcattttgaacatctggcgtgcggtgtggccgcatctaagtccaaggcactctgtccccgacagtcccgcttgagatccttacctgcccagagtccatagcttcagccagcctctcggggctcagctccaaggaggctcctggccttctgacccacgaggctagctccttctgaaatggggtggtaggcggggtggtgaggggagcccgatgggcagccgcgccctccccgcacccccgtctttgcactccttacacagagccgagtactggtcagcgccgtcaccttcagctgcatgaggctggcctcagccaggctggggggctccaggaggccccgtgacaggtccacacaccgcagcatagcaccgaggttcccctcataccacgcctcactgcccagccagcaggtgtcagggcccgaacagcaaagccccttcctgcgtcctcccagcctccctgggccctggctccctactcacccactcttggcagcagagtccggctcctcctcagtgggcactgccagcagtggtcggaggctgagggtccgcagctgctgcacgcagcccttcacctcctctgctgtctcaccagccacaaactgcccatagacggatgctcggagaaatgcgcctgagagccgggagcccaggagtcgccgagaccaggcctggagctgggtgacagggagcgagggctcagcgccaggctatgaggagcctccaggctggtcctcaggatcactgctcaccaacagcccgtgagtgacgagtgggggccaggcacacagccggagaaccagcaaggcccgtgtcagctctcctgtgcccttaaggtggaaggccccgccatcaaagctcagggactgccagcccctggaggggggaccagcttgggaacagagcacgtaacaggtccggagcatcctgggtccctggctgcctccacaccagggaaggttctctggaggcagcaagttcaccaactgccccttgcccagaccaggggcagtgactgattaactgggcaaagcctcaggatcacaggctccttgggggcaattaattattaacaaatggggacagagttcagagtaacggaaacgggaggtgaaccccagtaacagcccccaagaatgctcagcacaacagcctgcacttattaggtaaccaccatgtgctggggaaagcaggggctccggagcaaggatccctgggctcaggacaccgggctttgtgatccaggacaggctacttaatcacttttgtggcaattgcttcctcttaaaattggaaacgctgtagtgttattgaatacatttgaaaatacggttctcacgtttgtaatcccaacactttgggaggccaagaccgaggagtttgagactaccctgggcgacatagtgagaccccatctctacaaaaaatacaaaaattaactgtgtgtggtggcacacacctgtggtcctagctactcaggaggccgaggaaggtggatctcttgagcctgggaggtcaagggtgcagtgagctgtgattgtgccactgcactccaccctgggtgacaaagtgagactctgtcgccaaaaaaagaaaaaagaaaagacaaataacctatataacccagctgttccatgctaagtacatatcctagagaccttaaacatggacagcaggaaacatgtacaggaaagaatgttcagaggagcagtgtctgaactacccaaatgtccatcaaaaggagaatggatacatatatggtggtgtagttatgcaatggaatactatacagtaatgaaaaagaatggatactgatacacacaactgtgtggctgaatctcacaatgtcaagtgaaagaagccagacaccaaacagggcaagctgtattattcttttttttttttttttttttttttttttgagacacagtttcactcttgttgcccaggctagagtgcaatggcacaatctcagctcactgcaaccttcaccccccgggttcaagcgattctcttgcctcagcttccagagtagctgggattacaggcatgtgccaccacgccccactaattttgtatttttagtagagacagggtttctccatgttggtcagactggtcttgaactcccgacctcaggtgatctgcccgcctcagccttccaaagtgctgggattacaggcatgagccactgtggctggtctatacttttcaataaatataaaagcaaggaaagtgaaactgcagtaaaatgttgggaatacatgcgtgggtggtcaaactatgaggacaagaaaagtaaggacatgattatcacagaagtcagagaggtggttgattgtgggggatgggaggaattgtaatggggtagagggatatggggacttctatatcctattttctttttttaaaatggaaaccatatgtcttaatttttttgttttgttttgttagacgtatccttgctctgtcacccaggctggagtgcagtggtgcgatctcggctcactgcaacccccatctcccgggttcaagtgattcttctgctttagccccctgagtagctgggactacaggcacccaccaccacacctggctaatttttgtatttttgtagatatggggtttcaccatgttggccaggctggtcttgagctcctgacctcaagtgatccaccctacttgtcctcccaacatgctgggattacaggcgtgaagtcctaggtctttttttttttttttttttttttttgagacagagtcttactctgttgcccaggctggagtgcagtggcacgatctcggctcactacagcctctgcccccgggttcaagcaattatcctgcctcagcctcccgagtagctaggattacaggcgtctgccaccgcgcctggctaacttttgtgtttttagtagagtcacggtttcaccatcttggccaggctggtcttgaactcctgacctcatgatccacctgccttggcctcccaaagtgctgggattacaggtgtgagccactgtgcctggcagtggcttctaggtcctaggagtcctaggtcttaacatggatgatgattcatagttgttcacattgtaaggttttttttgttttgtttttgagacagagtcttgctctgtcttccaggctggagtgcagtggggtgatcactgctcactgcagcctcaaacttctgggctcaagcaatccccccacccaccacctccacctcccaagtagctgggattacaggtgcatgtgatcacaccgagggtaatttttaattgtttttttggtagagacagagtcttactatgctgcctaggctggtcttgaacccctggactcaagcagtcctctcaccttgggcctcccaaagtgttgggatttcaggcatgagccacggcacctggccctcacattgtaagttttttttttttgagacggagtcttgctctgtcccccaggctggagtgcagtggcgcaatcttggctcactgcaagctccgcctcctgagttcatgccattctcctgcctcagcctcccgagtagctgggactacaggcacccaccaccacgcccggctaattttttgtatttttagtagagacggggttttaccatgttagccaggatggtctcaatctcctgacctcgtgatccacccgcctcggcttcccaaactgctgggattacaggcgtgagccacactgcgcccggccttgaaatttttatttattttcttatttatgtatgtatgtatgtatgtatgtgtgtatttatttatttattcatttttgagacagggtctcactctgttgcccaggctggagtgcagtggcacaatttcggctcactgcagcctcaacctcccaggctcaggtgatcctcccacctctgcctcccaagtagctgggactataggcacatgccactatgcccagctaaatttaaaaaaatttttttttcctttcttttttgtgatgggggatctcactctgtcacccaggctggaatgctccagcatgatcatggctcactacagcctcaaactcctaggctcaaacaatcctcctaccttggcctcccaaacgctaagcttataggcatgagcctctgtacttggcctgccttttttttcttttctttttttttttggctccatcttgctctgttgcctaggctgcagatgtctgctcactgcaacctccgcctcccaggttcaagtgattctcctgcctcagcctcccaagtagctgggattacaggtgtctgctaccatgcccggctaatttttgtacttttaggagaggcggggtttcaccatattaaccaggctggtcttgaactcctggcctcagatgatccgcctaccttggcctcccaacgtgctgggattacagacgtgagccaccacgcccagcctagggcctcatccccagaaatgtgattactgggtaggcattggggtgttgaaagctcccctggtggttcaaatgttcacccaggtgaagaggcacggcccctacaatcggacaccttagcctctctaaatggggtcctccctccctctttgtcttttcactgtccctggaacacacccagcttcctgctgttgcatttccgctgttccttttccctgaaaactccacccttccttctttccctaattaactcccacctgccctcaggtgtcagggtttaagacaccccctcaaggaggtctgccttgagcagcccctcccagatgagggggagttttaccctttcacattttaacaccagccttgtagctcttgtcatgtttattcgtctgtgagtgaagactcagtttctctccccacgcccctgctagactgtgaacaccatgaggtcggggggtcacatttggttttgtcattaatttatccctactgcttaacacaggacttatttttgttgaatggacttatttttgttgaatgggtaactaatttaatagatttctttggtatttgctggacaagggacttatagattgcatcacatcaattcaagcagattctggataagacccacctttttttttttttttttttttgagacagggtctcactctgtcgcccaggctggagtgcacaatgtcggctcactgaaacctccacctcccgcattcaagcatgctcctgcctcaggctcccgagtagctgtgattacagttgcaggccatgaggcacacgccaccatgcccggctaatttgtgtgtgtgtgtgtgttttttttttttttaagtagagacaggtatttcacattgttggccaggttggtctcaaactcctgaccttgtgatccgcccgcctcggcctcccaaagttctgggattacaggtgtgagccaccgcgcccggcctcgaagtttttttgtttttttttttttaatgagacatagtcttgctctgtcaccagctggaatgcacggcgcgatctcggctcactgcaacctctgcctcctgggttcaagcgattctccacctctgcctcccaagtagctgggactacaggcgcacaccgccacgcccagctaattttttgtattcttttagtagagatggggtttcaccatgttggccaggctggtctcgaactcctgagctcaggcaatccgcctgcctcgacctcccaaacatggccttgggaatcgccatgtttgggtggacccagttgggtggcctgcatttgcatattaaaggttgccggcctggttctaagagctgctttaaaaacaaaaacctccaggccacgcctgtaatcccagcactttgggaggctgaggcgggcggatcacctgaggtcagcagtttgagaccagcctggccaacatggtgaaactccgcctctactaaaaatacaaaaattagccgggcgtgatggcgcgtgcctgtaatcccaactactcaggaggctgaggcaggataatcgcttgaaccggggaggtggaagttacagtgagccgagatggcgctattgcactccagcctgggcaacagagtgagactccgtctcaagaaaaaaaaaaaaaaaaaaaggtagaaattagagagtatagaagagaggcaatcttggaagaaataatggctgagaattttccagaactgatgaaaaatacatattcacaaagaagcaaagatatcttaagctagataaaacaaaagaggccgggtgtggtggctcgtacctgtaatcccaacactttgggaggctgaggcgggcagatcacgaggtcaggagttcgagaccagcccggccaaatggtgaaaacctgcctctactaaaaatacaaaaattagttgggcgtggtggcacgtgctggtaatcccagctactcgggaggctgaggcagaagaatccctcgaacctgggaggcagaggttgcagtgagctgagatcgcccattgcactccagccttggtgacagagtgagactccatctcaaaacaaacaaacaagcaaacaaacaaacaaacactaaagaaatccatgcctaaacacatcatactgaaatggcagagcattgaagctaccgaggtctattatttatctttgcatcctccagagtgtagcctggactagatgctccaccaattcaattacatcaagagggtgggtatcccaggttgagaccacagacaaattaaaggcaaggaggtagaaacaaatatggctataagaaggaaaagcatttttctcacctatctgaggcacacaacctggattgggggaaagtgaagttgaaaatgagagtgtgggagagggagagactaggtggagagaatttttgtttcgttttgttttagagacagggtcctgttctgtcacccaggctgtagtacagtggtgtgatcgatcatagctctcatagctcactgcagctttgaactactgggctcaagggatcctcctgcctcagtctcccgagttgctgggactacaggagtgtggcaccacagctgggtaatttttgtgttttttgtagagatggggtctctctgtgctgcctgggctggtctggaactcctggtctcaggtggtcctcctgtctcagcctcccaaagtgcttggattacagacatgagccacccacacctggtcactggggaatcctgagtgccctgcaaaacagaacacaatgggctgctcaacagtagccatggaaggttctggaataaagttcccagccggtccttctgtgggtgattgtccattttgtggtaagaggcaaaggggctctaacaccagcagagaggcagagccataggtgggagagtccctcttattctctctggttgggtcaccaggtgaccccataccaatcactgggattgaagaataaggtattccagccagctccagtgctgtgcctgtttctggagcttcaagagtgctcaaccaatgcacaaaacctacctggggcgtggtggctcatgcctgcagtaccagcactttgggaggccgtggcgggtggatcacctgaggtcaggagtttgagaccagcctggccaacatggcgaaacctcttctctactaaaaatacaaaaactagctgggggtggtggcaggcgcctgtaatcccagctaccgggaggctgaggcataagaatcgcttgaacccgggaggtggaggttgcagtgagccaagatcgcataactgcactccagcagcaacacaggtgcactctctctctaaataaacaaataattaaaaacaaaatgaaacaaaaaactggactcatgcgtgactctgatggttccaggaggtgatacatatacagaacatagaatgtgagctggcatgtgttaggagctcataaatgctgtctgtcactgctgctgcagcgactcattggcttcctgtcacccacaggataaagcacaaacccataagatgagctttgtggtttatctttggccatctcactagccttaattcctaccactccctgacttgggggttattctccagcaacaattttagggaaatcccttcccacactgtgctcctggagtcttctttgtctccagcccctgcacagctacttatcccttaatactggagtttggtgacagcttaggagcagaggacagtccagccagttttaatctccagcacagacctctctcctgagctctggaacccaatgtacacacacacacacacacacacacacacacacacacacacacacacacacacatgctcattcagaatcccctcatggattggttcttctcaaacgggacacgaccgcaccctggtgggagcttgggaaatttgcataattgtttttggctgcagcattgattggagggcattacaggcatctagaggcaggaccaggaatgctggacgctgaaatctgcatccagaacagtttgtaaatgtctttgcaggcgcttctgtgcgtaaaataagtttacagttatctgaaattattaatataacacatataccatacacacaaaattttggtatggtttaaaatatattgacattttctgaaatgaaactatgatgtaaatttatttttatttatctattttttttggagacagaatctcgctctgttgctcaggctggagtgcagtggtgccatctcaactcactagaacctctgcctcccgggttccagtgattcttctgcctcagcctcccaagtagctgggtttacaggcctgtgccaccacgcccagctaattttttgtatttttaatagagagggagtttcaccatgttggccaggctggtctcaaattcctgacctcaagtgatcctcctgccttggcctcccaaagtactgggattacaggcgtgagccactgtgcccggcttctgatgtaaagaaagtgaaaattgtgtacttttttgttcagaatggcaccaatggttatacatcatatcagaagaatcacaattccaacaatgccacctatgagatgtaatgtaaaattctgaatgaagtatagcacacataaagaaatgtgcccatatcatgtgttcagtatgaattttcaggaagtgaccagaaagtaaatttgacgcaagtgacacttgaataactaacacccaagtcaagaaaacaacttcgtaatcccagcacttcgggaggccaaggcaggaggatcgcttgggcccaacctggacaacatagtgaaactctgtctctacaaagataaaaaattagccatgtgtggtggtgcacacttgtagtcccagctacacaggaggctgaggtgggaggatcgcttgagcccaagagttggaggctgcagtgagccatcatcacaccactgcactccagcctgggagacagagcaagacaccatatcaaaaaaaaaaaaaaaaaaaaaaagaaagaaagaaaagaaaacaacattatgaggattctcaccccaagccttcctggtgccagtttcaatcaccatccccctctctcccaaaggtaaccagactctttgtttgtttgttgagacagggtctggctctgttgcccaagctggagtgcagtggtgtgatgatggctcactgcagccttgaattcctgggctcaagcaatcctcccacctcagcctcctgagtacttgaggctaccgttgcacaccaccatgtccagctaatttttgtattattttgtagaaacagggtttcaccattttacccaggctggtctcaaactcctggtctcaagcaatctacacatcttggcctcccaaagtgctgggattacaggcatgagccccggctcaggttatgcacttttatagtcagtagtattagtaacatgtggttgtatccttctcagtaatttttttttttttttgagacagagtctcgctccgtcgcccaggctggagtgcagtggcacggtgtcggctcactgcagcctccgcctcctgggttcaagcctcctgagtagctgggattacaggcacgtgccaccactctcagctaatttttatatttttagtagacacagggtttcacatgttggtcaggctggtcttgaactcctgacctgaggtgatctgctcacctctgcctcccaaggtgctgggattacaggtatgagccaccacgcctggccccttctcagtattttatatcagggggctccttgtgtcagtttgtcccatgactggtagcatcaactttgatcatctggtgaaggtgacatctgtcaggtttatccactgtgaaattactatttttccccaagtaactaatgcaatacatgctttttaggctctactaatttgagtttccaccccttgcaaattatttatttcctcctcagttaactaaagacctcattcaaactggtttaagagtgaaggacatttaggccgggcgcggtggctcacgcctggtaatcccagcactttgggaggccaaggagggcggatcacaaggtcaggagatcgagaccatcctggccaacacggtgaaaccccgtctctactaaaaatacaaaaaattagccgggcgaggtgacaggtgcctgtagtcccagctacgtgggaggctgaggcaggagaatggcatgaaccctggggcgcggagcctgcagtgagccgagatcgcgccactgcactccagcctgagtgacagcgagactccgtctcaaaaaaaaaaaaaaaaaaaaaagagtgaaggacatttatggttgcaactaactgaaaatgacattcagactgacctaagtggggagggaaactggtagtctagaagtagccctgacttcaggtgtggctggatccagtggcttggtacaactaggcatttgtcttgttcatcaatatctgtatagattaagggggactagatccggggaaggcagaagcaatagatgtccgctacactgaatcagaaaaaggagaggaggaagtaggaactgcatgaagagacccagccacagcctgcggttactttggagagcttcttccaagtggttcatggtgctgagcaacccaggacctggcttagcagcatattccttggccacagtggttggttccaggacaggcataagacccagcctgggctgatgaaagacagccccagagctttccagaactattggcataaagaggcactctggctgctgagctcatgggataccagcctagaactacaagtggtcttctctgtttcccaaataaagggtctacccgagaatgaagctagaccttgcatggctatgtttcaatactaggtctggcagtgtctgaagccaacgctaccccctgcaattgtcagctgcaagagccaacaaatttcctttcctgcttaagccaatgtagaatagaatgttctaggttttgcagggaatggtggctcacgcctgtaatcccagcactttgtgagactgaggcgggcagatcacttgaggtcaggggttcaagaccagcctggccaacatggcaaaaccccatctctactaaaaatacaaaaattaattgggcgtggtggcgcacacctgtaatcccagctatgcgggaggctgaggcaagagaatctcttgaaccaggaggcagaggatgcagtgagccgaaataacgccactgcactccaacctggactacagagtgagactctgtctcaaaaaaataaaataaaaaagaataaaaatacaaaaattatctgggtgtggtggcatacacctgtagtcccatctacttgggaggctgaggttcaaaaattgcttgaacccaggaggcaggggttgcagtgagccaagatcgtgccactgaactccagcctaggtgacagagataaactgtgtctcaaaaaaaaaaaaaaaaaaaaaaaggctgggcacagtggctcacacctgtaatcccagcactttgggaggccgaggcgggcggatcacaaggtcaggagttcgagaccagcctgaccaacatggtgaaaccccgtctctactaaaaatacaaaaagttagctaggcgtggtggtgggcgcctgtagtcccagctactcgggaggctggggcaggagaatcacttgaaacaaggaggcagaggatgcaataagccgagatcgtgccactgtattcgcagcctgggtgacaaagtgagactctgtctcaaaaaaataaaaataggccaggcgcagtggctcatgcctgtaatcccagcactttgggaggccgaggcgggcggaccacttgaggtcaggagttcgaaaccagcctggccaacatggtgaaaccccgtctctactaaaatatacaaaaattagccaggcgtgatggcaggcgacttaatcccagctacttgggaggcagaggcaagagaaccgtttcaacctgggaggcagacgttgcagtgagcagagttcgagccattgcactcaaacctgggggataagagcaagacttctctcaaaataataataataataataataataataataataataaaaaataaaaacaaaaataaaaaataaaaattaaaaaagaatgttgtaggttttttctttgaaaaggaaaaatatacaattacatgttgttggctgtggatttatttgaaacaaaaagaaaaaatatacaattagaaaaattctactgttagaaatgaagtcaccttttaattacagggaaatcatttagatcttaatgtgtttatgtattccagtgctgtggtgtaaaaacttattttagtctgtgctgataaaaaataacattgtcatacaacaattggggtgtatttgtaaaaaagaaaacaaaagaaaaataaatatattgacaaacacgtgaactagaaagttttgataatatggttaatcaagtagaagtgtggtctgaagaaagtctgttcttcatggaaacaggtgggcttctcagctatcctgctattcaatagaaagatggagccaggcgtggtggctcacgcacacctgtaatctcagcactttgggaggctgaggcgggtggatcacttgaggccaggagtttgagaccagcctggctaacatggttgaaaccccatctctactaaaaatacaaaaaattagccgagcctggtggcggccgcctgcaatcccagctactagggaggctgaggcaagagaattacttgaacctgggaggtggaggttgcagtgagctgagatcgtgccattgcactcctgggtgacaaagcgagacaagaaaggaagggaagagaagggaacgggaggggaggggaggggaggtaaggggaggggagggaaggggaggggaggggagggaaggggaggggaggggagaggagggaaggggaggggaggggagagaagggaagggcagcggaggggagagaagggaagggaagggcaggggaggggaggggagggaaggggaaagagagagagagagacagagacagagagagagagaaagacaggaaagaaaagaaggaaggaagggagggagggagggagggatcctcttactgggctgttattatgaagcctgtttttaaaatcacttttattgagatatcatttatgtacaataaaaatgcacccatcttaagtgtaaagttcaatgagttttgacaaatctgtgcacccgtgcaaccaccaccacaatcgttatatagaatatttccaacacctcagaaagttctcccatgcctttttgcagtcaaccctcctctcatggccccaggaaacctctgctgtgctctctgccaccgtagattagttttgcctattttagaatttctataaacgaaagcacacacacagtacatattcttttcctctagcttcttttgattgtctgtttattttaatgcttatggagcatacttatgtttacatgtgtcatagtttatgcctcctgtgttagataactgtcggaaataataaaataataggtaggatgcaacatggattcataaattccacttattattagctatttcagacgtcatggaatgcaaaatgaacagagtttttcatatgtctttccccacttctgaaaactttacttcatgaagcacttagggaccctcagaatagcattttattttttatttttattttatttttattttttgagacagaatctcgctctgtcgcccaggctggagtgcagtggcgtgatctcagctcactgcaacctccgcctcctgggttcaagcaattctcatgcatcagcctcccaagtagctgggactacaggcatgcgccactactcctggctaattttttatatttttagtagaaatggagttttaccatgttggccaggctggtctcgaactcctgacctcaggtgatccacccgcctcagcctcccaaagtgctgggattataggcgtgagtcaccgcacccggcagcatttcatttttgagacgacgtttacaatctgccctgtccttttggagaagtttagtttctaaagccaaccccaggatgcaccttgtttctactctggtaccagctgaaccatctctgtcactcagccccctccatgtcctctcctgacaccaagtccctttgggttttatggagctcacctaaccagctcggcccaggctgtaatgagagagaccagtggagtgtaaattcctgcaggtgcaggacaatggggttgagagggctcttacaccagatgtcccctcagctcgaagggcagagaatcgggttccagagtgtccaagtctccggccacctggtcatagattcctcttggatcctgatatgtgtcttcaggccagtggaggtcccagggtccctgacaggcaaaaagtggagttagaaccatggagagatgccctgtaggtcttcattgaagatctgggggatacatgcccctgcttaacttcccagaaaaaagtgttttagcttttactaaaatcccaacatatacaaaaaaggagtgtgattataatgaatgcttatgatgaaccccatgtgcttatcacctaacttcaacaatatcaggctgggcacggtagctcatgcctataattccagcactttgggatgccaaagcaggaggattgcttgagaccaggagttcgagaccagcctgggcaacatagtgagatcctgtatctacaaaaaataattttatttttcttagacagggtctggctctgtcacccaggctggagtgcaatggcacgatcttagctccctgcaacctccaccttctgggctcaatccatcctcccacttcagcctcccaagtagctgggactacaggcatgcatcaccacacccagctaacttttgaattttttttttttttaaagacgaggtttccattgtggcccaggctggtcttgaactcctgagttcaatcgatccacccgtctcagcctcccaaagtgctgggattataagtcactgggattatgagccactgcaccgagcctataaaaaatatttttaaagaaattagctaggtgtggtggtgagcgcctatagtcctagatactcaggaggctgaggtaagaggatcgcttgagccccggaggtcaaggctgcagtaagccatgatcatgccactgcactcccgcctgggtgacagactgagactatctcaaaaaaagaaaaaaagaaaaaagaaaaaaccagtagcaacccttggtcaattgatttctctgtatttctatcttgttcccctccccgactaactggattattttgaagcaagcccaagatacccaatgatttcatgttagaaaaataatgtaaatgtcagaaatataaaacctttaggccaagcatggtgactcatgcctgtaatcctagcattttgggaggccaaggcaggtggatcacttgagatcaggattcgagaccagcctgggcaatgggcaaaaccctgtctctactaaaaatacaaaaattagccgggcatgatggtgcatgcctgtaatcccagctacttgggaggctgaggcaggagaatcgcttgaacctgggaggtggaggttgcagtgagctgagattgtgctactgcactccagcctgggttacagagcaagcctccatctcaaaaataaataaataaataaaatttttaaaaatgaaaactttaaaagtccatgttatcaggtatggcaactgtggaatgtaagttatgattatattgtcctatgaatttccaaaacagttccctaatcataatagaaaaacaaaacaaagcaaaaccaaacaaacaacaacaacaaaaagaacatgaatggtagccctaactggggatgtattttgttctagggctgggagaaaatgattattttagttcagcaaactttagagcagattggcccatgctccaaatatggcctgccacctgcttttttatactgcccaagagctaagaatggtttttatttttttctttttctttttctttttttttgagacggagtcttggtttgttgcccaggctggagtgcagtggcgcaatcttggctcactgcaacctccgcctcccgggtttaagcgattctcctgcctagcctcccgagtaggtgggactacaggcgccagccaccacacccggctaactttttgtatttttagtagagacggggtttcaccatgttggtcaggctggtctcaaacttctgaccttgtgatccgcccgccttggcctcccaaaatgctgggattataggcatgagccaccgtgcccggcctggtttttcattttttaattgttgggaaaaaatgaaaaaagataacatttgtgacatagaaaaattacatgaagttcaaattacagtgtccaaaaattaagttttgtaggaacatagccacactcattcatttatgcatcgtctatggctgcttttactttacggtggcagagtttgtgtagagtttgaggaagaccgtatgtcccacacagcccaaagcatttactactatccggccctgttcggaaaaagcgtgcagcctccatctacgctttagagagtgcatatggtccagcaccatggacagcgctttgcgccatgctggtgaggagctaggatctgacaacagtcccggtatcggaggtcgttcacagagacagaaggaaatccttggcccaggaggtgccagagcatcagccaaggccacacaggaaatcaggggttctgtcccatctccctaactgtgcagcaatgggtggggattggctggtggtcaaagtgcctgtctgttgtttttgcctgtacagccaccatcctcatttccctgtgagctctctgtccctctcctactctcagcccagtgacctgagtggggctggcccctactccctgatcccatggtgaactggcccaggcctctcctgttagcatattccatcccctgactcagggatgtgttcagtgatgaggatgtgacccaagctagaccaattaagtgtcagcattgggcatttggggccactggaaaacaggtatactctttctttgaagatttctaatctcgtaggatacaaatctagattttctgggaatattttttccctttcttttttgaaacagtctctcaggctggaatgcagtggcacaatcagggctcatggcagcctcaacttccctggctcaggcattcctcctacctcagcctcctgagtagctgagaccacaggcatgcaccaccatgcccagttaattttttaaactttttttttttttgagacagagtcttgctctgttgcccaggctggagtgcagtggcatgatctcggctcactgcaacctctgcctcctgggttcaagcgattctcctgcatcagcctcccaagtagccgggattacaagtgtgtgccaccacatccagataatttttgcattttttgtagaaatggggtttcaccatgttggccaggctggtctcgaactcttgacctcaggtaatccacccacctcagcctctcagagtgctgggattactggtgtgagccaccatgctcggcttaacttttttttttttaaagatggggtattattgtgttgcccaggctggtctccaatacctgggctcaagcaatccacctacctcagcctgctgagattagagatatgagccgtgaccatgcctagccataaaaacatttttagggaagaaattctgggcccagctgggcctgatgacaattgtatgccttgatttttcagttgaatgggcccccaaattctctctttctctctctttaaccagtggagtagatatggctaattatctttaaaaattcatgtctacttccttccacagtagcagaattgcagcaaggcacatcactgctaagctagaccacatttcacagcctcctttgccgtcagatgtgaccatgtgactctcttcccaccaggggagtgagagcagagtggtgtgcaccatttctgggcctgggccacaaggcagggttgtgcctcctccacattctttcaccttttcccatgggttgaacccccagtgaactggctcattcatgtagactcggttgacttgagcagggccactcacgtctgactgaaaaagaaatagactgccttctttttttcagagacagggtcttgctctgttgcccaagctggagtgcagtggcaccatcatggctcaccgcagcctccaactcctgagctcaagggatcctcctggctcagcctcctgagtagctgagactacaggtgcacacctccatgcctggctcattttaaaaaatgttttgtagagacaagtcactatattgcccaggctcgtctcaaacttatgggctcaagcgatcctcctgccttggcctcccaaagtgttgggattacaggcatggaccatcatgcccagccgactgtctttaagccactggatcatggtcaggcctctttgttacagcagctagctggccctaactaatacaagcaataggaggtaggctcccagcactagccaggaaggatggttgctgatgcaaagcttctcaccatctgcacttcatcgtagaggggtccccaggctccagacggggggtacgttctttctacctcatcatacaagtgcccagggaaggccatatcctcatcttcacctgtgaaacctggagttggagtggaagggagacacgatcaaggcacccagtccaggcgtcgggggtacctctgagtgagggaatcctgacatggtcctaactcacctcgggaataagacacctcctcctgcgtcgggggcagctgggggctgaagtccctcagggagcggtaatacggctctgcctctgttgtgctgacctgttccccacacgcaaaacaaacaaagccctttccatcctctgaccccactgtgcccggaagggcaatgatcaacctgatgctaacggcagggcttcagtcgccgtcggtgccctgattgtggggtcaccagggccacccccacttaccgtggagctctgagtgtcccgctctcctgtccactggctctcctcatattcgttcctgactcggtcctcttccgaccttccaggatgaaggtgtggggggaagttgagtgctgccccccgccaccagtctcccccaaacctccctcagagccttctttacagaaaaatatccccacttaccctgcctctgtcttctctgagatgcctgaaggaaacaggaataaagggctcagtgaccctatgcaagccccccaccccggccccaggaagaccttcagtatgcagcaaccacagggttccctatcaccctcgggtctccaccctggcagggaagggtctctcctcaccctcagcaagacgcctgagtctccgctgccagaggacccccccgacacaggaggcattggagaggagcagaagccccccaagagcgaacagcacaggcagcaggggcagccccgagggtcctaggggtggaagatacccctcagtgaatcccagacaacaggctgtaggccaggggtgggtctccccgagaaagtgtagccctgaccaagtccctcccccagggtcagagaaacagatgggcagaggtctctgtgcccaccctttctgcccacccaagggcaggtggcttctttcttaagtcaagccattagcaaaacttcctccgtttgcttgaactctgcaaactcagaacggaactctggactcaggagggagcttcagctcgttagctgggcactgaagactttctgtggtccagcctcttcccacgcctccagccatgcccaccaaacttagaccctggtactggactgtccagccacacaaatcaaccaccagctgtttccagaatcactgaagcaaattcacacctcagagctttggaatagttaagtgtctgtcctcaaatgtcctttcttctcaagcaaacttctgtttgcctttcaaattctatctcaaggtcaggcgctgcagcacatgcctgtaatcccagcatgttgggaggtcaaggtgggagaatcgcttgagcctaggagctcaagaccagcctaggcaacatagtgaggctgattctttacaaaaaaaattaaaaatttagcagcatggtggtgcatgtctatagtcccagctactcgggacactgaagcaagaggattgcttgaacctggtaagtcaaggctccagtgagctatgatagcaccactgcactccagcctgggcagcagagcaagaccctgcctctgaaaaaaaaatcccatctcaaggacttctttattttattttgttttttaattaagacggagttggctgggcacggtggctcacgcctataatcccagcactctgggaggctgaggggttggatcacaaggtcaggagttcaaaaccagcctggccgatatggtaaaaccctgtctctactaaaatacaaaaaattagctgggtgtggtggcaggcacctgtagtcccagttacttgggaggctgaggcaggggaatcacttgaactggggaggcagaggttgcagtgagccgagatcacgctactgcactccagcctgggtgacagaatgagaccctgtctcaaaaaaaaaaaaaaaaaaaaaagagtctcactctttcacccaggctggagtgcagtggcatgatcttggctcactgcaacctccacctgcagggttcaagcgattcttctccctcagcctcccaagtagctgggattacaggcgcatgccaccacacccggctaattttttttttttttgtatttttaatagagacggagtttcgccatgttggacaggctgttcttgaactcctggcttcaagtggtctgcccaccttggcgtcccaaagtgctggcattataggcgcgagccaccgtgcccagcctcaaatgacttctttccaccaacttccatcccagccaatatcaggctgacttggctgctatatccctgaggacaaggctgaacccctctaagtaggcatctgttgggcgggcaatctcccctgtcttctactaatagcacttttttcccctggggagaacagccactccccaatctcagtcttgggttcaggcaggactccacagtgggcacatggcccggcctggaaaataagagtctccattcctctctccacagtgattgtttagacacaggcatttgacccaacgtgtgtttttaacaaaacatttaggacaattctactagctgtcaagaagatggaggtggaggagggcttctctgcccctctgattgaagaaactcagaaagaagccaccacagatgaaggcaaagttgagagagggtgagaaacagatcgctggtgagatttttgagcacctgaaagtggccacacttggaattttttatttcatataccaagactttttcttttttttcttgagacagggtctcaactctgttgcccaggctgcagtgcagtggcgtgagctcggctcattgaaggctcaacctcctgggctcaatcaatcctcccgcatcagcctcctgagtagctgggactgcaggcatgcactgccatgcctggctaattttttttgtttttgttttatagagatggggtttcaccatgttgcccaggtttgtctccaacgtctgggctcaagtgatctacctgcctcagcctcccaaagttccgggattataggcatgagccactgtgcccagccaagccattctttttcgtgttgacaaaacagctgcatttctgtcacttgcaacctttttctcgggctctgaaggggatttttttgccaaatggttgcaatcatctcccagtagtcacatccttgagtgcggggcctttccacactgactctgtgttgagccatgtgacttgctttggccaatgagacacaactatgacggaatcagctagtaaattgctgcttttgacccccgtgaccacctccatgtgaaaaagtcaagaagagacacgcgcccagttatctccattgttccaaccaagagccagatgactatcagaagtgtgggaagggggcaaccctagaccacccagtccagtggagctgccagctgactgcagagatgatttaagccagcccagaccagcactgttccgccagactcagaatcatgaggaagaatgttgctataagcacccatgtttggggtggttcattatacagcaaaagctaactgatgcaggcttcttacaggacatggagtgagctaattcttacggaattaaactaaatttggaagagaagaaaatttatcactccaggcaagaggaagatctaagaaaaaaaaaattggccagatgcagtggctcacgcctgtaatcccagcactttgggaggctgaggtgggtgaatcatgaggtcaggagttaaagaccatcctggctaacgcggtgaaacctcatctctactaaaaatacaaaaaattagctgggcgtgttggcacgtgcctgtagtcccagctactcgggaggctgaggcaggagaggaagccgggaggtggagatagcagtcagccgagatcgcaccactgcactccagcctgggcaacaaacagagcaagaatccatctcaaaaaataaaaaaataaaaaaaaaaaatgccgagtgccgtagctcatgcctgttatcccagcactttgggaagctgaggcaggcagatcacttgaggtcgggagttcgagaccagcctggccaacatggtgaaaccccgtccctactaaaaaagtacaacaattagccaggtgtggtggcaggtgcctgtaatcccagcaactcgggaggctaaggcaaaagaatcgcttgaacctgggaggtggaggttgcagtgagccaagattttgccacttcactccagcctgggcaacagaatgagactctgtctcaaaaaaaaaaaaaaaaaaaagaaagaaagaaagaaaaaagaggaagctctaaggagtctgcaagtctgcaattctgcagggacagaactaagtcttttttttttttttttttttttttgagatagggtctccctctgttgccaaggctggagtgcagtggctcagtcatagctcactgcatcctccaactcctgggcttatgcaatcctcccacctcagccttctgagtagttgggactacaggcacatgccactacacccagctattttttatttttgcaaagatggagtcttgctatgttgcccaagctggtctcaaactcctgggctcaagtgatcacatgccttggcctcccaaagtgttgggattacaggcgtgagcgactgagcttggccagaactaagtcgttaagcagctgtgactacaagcagaggaggtagggtcagagaccaggaggttccattctcaggggagccgggagggatcaggggactgaggacttgcctgaaggtggctctgtgggcagctggtcttcaggttctccagaaggctggtggagacctggggggtggatatacagattgtgacttaacactaagaatctgagataagctttaaatatttctcagcctcttcttaagcctattagattcatgggaactggtatatgactgcttaagaatatttcaaagagagctagaaattgctgataataatgacaatactattaatagcaattctaatggtaacgctaatgctaagaataatttgttttttgagactgaacctctctctattgcccaggctggagtgcagtggcgcaatctcagctcactgaaacctctgcctcccgggttcaagcaattctcctgcctcagcctcccaagtagctgggactacaggcacctgccactatgcctggctaattttttgtatttttagtagagatggggtttcaccatgttggccaggctagtctcgaactcctgacctcgtgattcgcccacctcggccttccagagtgctgggattacaggcgtgagccactgcgcctggccatttttttttttttaaagagacagggtctcactctgtcgctcaggctggagtgcagtggtatgatcatagctcactgcagcctcgacctcctgggttcaagctatcctcccgcctcagactcctgattagctgggactacaggcatgcatcaccatgcctggcccaaaaattaactgttgatgagcactttcggtgtgcaaggtccttttcacccgaattatcaatttgttgagttaaccaaaaaagactttgggctctcgatcccttaataaaggtacaagttctaaagcaaaggaggcaagtgtcatactttatgttttagtgttcaaagggaagactggagtggggtggggggaagagcagagaagattgtaggggtgaaaaagtgtccttacttccattgagaaaaagcctgctctgtcaggaagaggaaaacagaaaggagaagcttgcggccaggagtggtggcacacgtctgtaatcccagcactttgagagactgaggcaggtggatc

SEQ ID NO: 3464 - DNA, 505 bp, Homo sapiens
  Genbank Accession No. W02027
  unsure (1)..(505): n = a or c or g or t
ntttcaaatgttttttaatatcctgcaggtaataacactgatttttctaatactcagaaacatctacttagcagttgtgatactaatttgcaaaatgtaataatgttatacaaatataagatactactaaatacatagtagaaataattgcatgattcctgatatttatattcaaggtataaacatgactgatttcgctgatactacagaataaaaaaaataaagctgctatgtaaaaaattaaagaatatctcaattacgatatttttgttcccaatctctttcagacagatctatgaaataatatagaatatactatcaatatgttctttcatatgaagtgaaaaaaatgggatttaagtagtgagataatttcnattttttacntttttaaaaaaatagacagggnccctggctatggtggcccagccgggtccccaactcctggggctccgtggtgcttccngcctcagcctccccaaggtgccgggnttatagggcctgg

SEQ ID NO: 3465 - DNA, 379 bp, Homo sapiens
  Genbank Accession No. W02041
  unsure (1)..(379): n = a or c or g or t
gggattaggagaacactctttaatgataaagcctgtccaagtactaaggacaattagagtaggcaggtgacctgtacaaagtattagtgataacacaacattcagcttcctaagagttaaaacgtgctgcttacatgaagggagatgatactgagctaagaagtcctggtatagagaagcagagagaccaacctacttcatattatttataaaatagagaatattctcagctaacatgctgggagaaaaaattcttccaaaaaggcagaattacaatcaatgccaagatttacaaattccatcatgtttaattataaggacaaaaataaacatttccttatttaaaaaaaaccccccaattttcccccaactatagcnt

SEQ ID NO: 3466 - DNA, 439 bp, Homo sapiens
  Genbank Accession No. W02695
  unsure (1)..(439): n = a or c or g or t
ttttttttttttttttatagaagtactctgatttttattgttatacaacatatatatataattgtttccccaaaatatgcacaattacatgtgtcaattttaaaaaatgaatgaagactataatgtaaaacctatagctgtaaaattcctagcacaatacagaagggtgaagcttcatgacaactggtcgtggcaataatttgggggacgtaacatcaacggatgagacaacaaaagcaagggaatacacatggtactgaatcagtgtatgaaaaatatcccaaacagacaaagcagaacatggaatagatatatngcacattgtagtattagtcacaaacatgttaccttggaagcaaatgtacccttaaggattgagttagattcagcaaacagggcacgtacaatcactggggatagcattcagccttaaaaataa

SEQ ID NO: 3467 - DNA, 485 bp, Homo sapiens
  Genbank Accession No. W03796
  unsure (1)..(485): n = a or c or g or t
tctgaggactcagctggaaccaacgggcacagttggcaacaccatcatgacatcacaacctgttcccaatgagaccatcatagtgctcccatcaaatgtcataaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctnggctctctatcaatcgccacagagaaaaggttgaccaagcttttggtgcatagcagcctggttggaagcattctggagtgctctgtctggccctgggtggggtttcattatcctggtctggtcaaacagggcaccttaaatcct

SEQ ID NO: 3468 - DNA, 362 bp, Homo sapiens
  Genbank Accession No. W04507
tttttttttaaacaatattcaagtttattaaacaaataaaaaaagtattataaaatgtttaactttcatcagcttcaaggtttatgttgctcccgaattttgcatacaactgaactttcaaatctgctaacactcgctgaattgattccactctggattctaaggcgtcaatttcttcttgcaaatttttctttgcttcttctaacatttcttgcgtttcttcttgagaatggctaatgaagacatcaccaatttgataaggtatcattaagcaatcatcatctgcaagcatgatgtcatcacaagcatcttctaggttttggagttgtttcttttttacttctatttcttccttcagctct

SEQ ID NO: 3469 - DNA, 228 bp, Homo sapiens
  Genbank Accession No. W04550
tttttttttttttttttttttttttttttttttagaaaaacaagttttctatttatttaaaaataagtttgtagttactacattgcagggacaggtattcttacacatacattctagtttgtataaaaggattcaaagaattatgcatcaaaactaacatagaaagtgtccacgtaacagtaaagaaaggtccaatcagtatgtacaaaaagaaagggcactgctatt

SEQ ID NO: 3470 - DNA, 526 bp, Homo sapiens
  Genbank Accession No. W07723
  unsure (1)..(526): n = a or c or g or t
gggagaacgccatcagctcactgcttaaaannanaccacaggactnattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtaccccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcacatggtacctgatgatcaaggcattccttcctaaaatgcttgctcagaaatctggcaatattatcaacatgtcttctgtgggcttccagcgtcaaaggagttgtgaacagatgtgtgtacagcacaaccaaggcagccgtgattggcctcacan

SEQ ID NO: 3471 - DNA, 351 bp, Homo sapiens
  Genbank Accession No. W15275
tttttttagatgagaatttaagcttttattaataaatcatgattttctattgaatacataataaagtacaattaacaataacataacattacaacattaaaaattaaaactttcagaatcaccttgatcaatatataaagctttagttccttatttcaacagtgttcttctcatatgcaaaacagcttcccaaaataagagattcgtgaatgaaattttataaagcttcctgtgtaccaaagagattgactccacatcaactgtcccctactgaaaatccaaaccatacaggcttgaaggaccagaactgagccacattctattaaagttatcaaagataaaatcttaaag

SEQ ID NO: 3472 - DNA, 445 bp, Homo sapiens
  Genbank Accession No. W15417
  unsure (1)..(445): n = a or c or g or t
ttttttttgtctttttattattctttattggtcctaccaatgtgactctttacccaggcccactgttcctatgcgcactggctttgtaggcattcacatcatatgtctgtgtcctgaaaatctcaattaatttctccttcctattccttttccatgctctgcctcattttctcagaaattgaaggcatttgattattattttnttgtttgggtctgtgtaaaggttccttggcaggagaacatgcatatgactttaaaataaagaccaacattctgacactaaggtaatgcacagaaaaaatacagtactcagacatcattgcaaataaataccccatacagatgaagttatctcaaatgtaacaatatttcttatgaatcaacactgtaacggaagggtaaaaataggagtccctacaactaggaataagaaatggcttattcc

SEQ ID NO: 3473 - DNA, 435 bp, Homo sapiens
  Genbank Accession No. W15495
  unsure (1)..(435): n = a or c or g or t
tttttttttttgaaaggttaaaaataacattcttttaataagtttaaacttttagagaaaagagaaatatactgagaaagacccatataactgcttcaacaaagaaaacaacttcttcattatcttcatactttacttcatattacaaattttgtgctactgttagatgatatattaattttattttcattacataaattgaggaagaaatgcagaatcagattcaaatatattacaaggcatttaagggaggtgtgtcctgttgctgaacagtaaattatctgaaaatctacttttttnttttttggagatggtctcattctgtcacacagctggagtgcagtgtcgtgatctcggctcactgcagcctccacctcctgggttcaagcaattctcatgccttagcctcccaagtagctgaggcaagagaaacac

SEQ ID NO: 3474 - DNA, 414 bp, Homo sapiens
  Genbank Accession No. W15528
ttttttctgttttaaagtttcctttatttctttagatctttatgaaacattccatcgtttgcagatcatagtgctttattaacaaattcatgtgttcttttcccatccctttaatacaaaaaaattattcatcagttattttcatctgacatttcactaagtacagaatgcataatgtcaacattattagatcagccattcaagtgggtcacataagtttatcctcattgtgccaaatacccactcaaaggataagctgaataacagatgcctccaggtgtatacaacaaccttagtttcttgacttgaactagtcctgtttaacaggtcaaactggctaagtctttctaagtaaactaaaaaagactcaagtacacagctgtacatacatatcatcagatgggtaagttcatt

SEQ ID NO: 3475 - DNA, 501 bp, Homo sapiens
  Genbank Accession No. W16686
  unsure (1)..(501): n = a or c or g or t
ggattttttaaagcttttctgttcaccctcctgccagnaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgtctaaacccccgacgcataaagtgtagaggagggatggccaagggtgggtggtagaaagtgtgttcaggctgacactggcaatgagtacagataattnacttnctctctaggggcaaagntgatggctctactttgtancaggagaactnc

SEQ ID NO: 3476 - DNA, 698 bp, Homo sapiens
  Genbank Accession No. W20094
  unsure (1)..(698): n = a or c or g or t
gctcttgaacccagaaggcgaaggttgcagtgagccgagatcatgccattgtactctagcctgggtgacgggagcaagactccgtctcaaaaaaaaaaaaaaaaaaaaaaagaagtagagacagggagacggggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctggcccagctttatggtcttttattccagtattccaccaaagtttgtttttcctgcattccagttctcaagtcttaaggataaagatngtacttgacagtttagtatatccataaaactatttgaaggtggttaaggttccttgggttcaattttccttaaaactttgcctgaatatnggaagattgtagggcaatgaaaaggtctactaaattaggaaaaccttgaaataaattagggatccnaggtaagagcccctaaacatcaagcaatctgggagtctgtaagaaatnaatattttttggataatcctaacnaatccacccngttggaagnggatccttgtccttgcaa

SEQ ID NO: 3477 - DNA, 232 bp, Homo sapiens
  Genbank Accession No. W20276
gttaactgtcaccttccactcagggcctctgctctatatctattcccttccagccagactggaagatgggggcttcccctacccctgaggatgaggacaagccctcggcagttcagcgttccgtgcttctcccttgggcagctctctcttgagccctcacctgtttctttctgtgaagcgagaatgtctgaaaataaataggaccatggcaaaaaaaaaaaaaaaaaaattt

SEQ ID NO: 3478 - DNA, 243 bp, Homo sapiens
  Genbank Accession No. W20391
  unsure (1)..(243): n = a or c or g or t
naaaaaaaaaccaaactattctttatttgatagccctgggacatggtgccctccacccaataaagcaccctccagcaaccctcccacccctcacccgatacatagacatagggacacacacacacacacacacacacacacacacacacacacacacacacagatctggatccgtcttcacttcctgttggcctgagcagtaccaataacacactggttcaccttggaaggcaaagcgtagaa

SEQ ID NO: 3479 - DNA, 187 bp, Homo sapiens
  Genbank Accession No. W20467
gtttttttttgagtcaaggtctaactctgtcatccaggctggattgcagtgacccagttatagctcattgcagcttcgaactttggggctcaagccatccttacacctcagcctctgagtagctgagacgacagatgagtgtcatcacatccagctgttttttgtttgcttgttgttttttgtttgt

SEQ ID NO: 3480 - DNA, 435 bp, Homo sapiens
  Genbank Accession No. W21426
  unsure (1)..(435): n = a or c or g or t
accaaggtgggccatgcgttgtttggtcttatacctgatgaagaaatggcaacagctgacagaaatgggtacagctcatcaaaaatgtgcagcaccggcagagggaagatacggggcaaatgtgcttcctgatgcttccatggggatgtgccctggtgtgcatctgcttgtcaggaagagtcacattgctgcttaacatgctggattgccctagtctttgcccnagccttcagaatggtcctgagaaaacatcactacttcgatgttctactttgctttccaaggagcaaaaataactttggagccttctgggaagtgtgcctgggattcttcagttggtttcaggcagatagttgagactgggggctttgatattcaaggtctttggcaagaatcccaggcttgaccaactgggtacccaggtcaaagattttt

SEQ ID NO: 3481 - DNA, 606 bp, Homo sapiens
  Genbank Accession No. W26716
  unsure (1)..(606): n = a or c or g or t
tnnnncagccgggaggataccaggatagacgctatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggntgcagacgccgagccactggagatcattctgcacctgccgntggtgtgtgaagacaagaatgtgccctacgtgttttngggctccaagcaggccctggggagagnctgtngggtctccaggnctgtcatcggctgttctntcaacatcaaagaagggtcgcaggttgaaaacaggagatccaatccattcaggaggccattgaaaggntcttaggcttaacctgtggggctctncangttntccctnccagttccccccagagnngattcaanttgggnttaccaggttaattnttaaannnnnnnnnnnnnnnnntnnnttnntnannnnnnnnnnnnnnnnnngntttttttnatnnnnnnnnntnnnnnnttntttttnnnnnnnntnnntnnnnnnntt

SEQ ID NO: 3482 - DNA, 617 bp, Homo sapiens
  Genbank Accession No. W26769
  unsure (1)..(617): n = a or c or g or t
tnnnatntagctcggncttanccaggcnnancntgttcaatagnnntanctagggtgntgtcagtcagaagagtgaatcaggtngaaagggtnnanagaagttgcctagagtttggtaattnaaaagaaaaagatntncttgttnngccccnngacctgaccgacactggttcccatgaagcggttaccaaagctgttctccaggagttnggtagaatcgacattctggtcaacaatggtggaatgtcccagcgttctctgtgcatggataccagcttggatgtctacagaaagctaatagagcttaactacttagggacggggtccttgacaaaatgtgtnctgcctcacatgatcgagaggaagcaaggaaagattgntactgtgaattagcatcccgggttntcaatattcttgtacctcttnccaattgggattctgtgctaagcangcaatccnctcccggggttttnttntgggccnccnaacagaaattgncaaaattcccnngntnttatagtttcttacaatngcccnggancctttnaanccaatttttgnggggattccnntnggcnttaccnggttnacttgccaaannnnnnnnttccccccng

SEQ ID NO: 3483 - DNA, 585 bp, Homo sapiens
  Genbank Accession No. W26996
  unsure (1)..(585): n = a or c or g or t
ncctcnntnnnnnttnnnnntcgctnttggaggtgccgaagacccttcttgcctactcctcactgccagctgggacctaggctcagtcctgtgtggtgcccatgatccttctggtgggggaagagtttaagttatagggcatttggctcaaattttaaaaggcctttngtttacctatatttctggaggctcctgtattctagaacccaatctctcacctgcttggnggaaaggntcatatttttgggnnccttccctatagattctgtagnattngagtgtggaaatattttaattgtgtntagatttctaagaaccaacactactcagtctcctgctagtctgactcctgaagcatcagcccttgtcatactgtattgactgtgtaccgtgcctttcaccttgagcatgcttcaggattttttttaaaccacagaacttgaatacatgagggaaccagagttcaaagtcctatgaacccttaggagggggttagagagtcttttttgggttgatgtttcttganggccctagaggngttgggttcaattagggagtngattcaanttgggttaccagtgatng

SEQ ID NO: 3484 - DNA, 639 bp, Homo sapiens
  Genbank Accession No. W27023
  unsure (1)..(639): n = a or c or g or t
ncnnnnnntngtnggnctcgcccaaacgaagtctgccgtctcctctgctgcacaactgcagcaggactgangtcacctgacgtcttctgggtgtggaaacgggtatttcatgtctcagggagtaggtttgtgcagttacagcttttctgttggtatgcataattaataattggagctgcaaagcagatcgtgacaagagatggacggtcagaagaaaaattggaaggacaaggttgttgacctcctgtactggagagacattaagaagactggagtggtgtttggtgccagcctattcctgctgctttcattgacagtattcagcattgtgagcgtaacagnctacattgccttggncctgctctctgtgaccatcagctttaggatatacaagggtgtgatccaagctatccagaaatcaagatgaaggccacccattcagggcatatctggnatctgaagtgntatttcttaggagtgggtcanaagtcaagaatctgtctgggcangtgaactgacgataaaggacncagcgccccttcttggngggantngatcaantgncgtttnnnnnnnnnnnnnnnnnnnnnnnnnnnnnnnnnnnnnnnnncnnnnnnnnnnnnnnnnncnnnnnnnnnn

SEQ ID NO: 3485 - DNA, 590 bp, Homo sapiens
  Genbank Accession No. W27503
  unsure (1)..(590): n = a or c or g or t
ttttntcatctggtctcacttcacagaaagctccccgggagccattagccttcagtgaagacaggaggcaagccatcatgcttttggccacacttgggtcagttacttttttgtgaatgtccatctttatcagagaagggaaattagcaaggaaagtttctggcagtacttcctgttcttcatggaaactcaacattattttctcagcctcagagagttccttgtcaccattgtgggctttgagagagccctaaagcattgtacctagtggtacctagtgacttccaaccaaagcctttgagtatgcactaaataggtgagaagaaaggagagaaggtttttaggttagaaaccctttaaccccatagaaggatatggtnttttggtaaagcttgganccaagtttgnatttttnggagggcttggagatgaagggaagnttcttaccagntngtaaganagttgagtngattcaaatggttnngttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 3486 - DNA, 839 bp, Homo sapiens
  Genbank Accession No. W28235
  unsure (1)..(839): n = a or c or g or t
gnnnnnngnnnnnnnnnnnttnttgagnaccgcagtngcagcagcagcagccgctgncgcaaacaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtcttatggaactgcagctcccacgattggngtcctggcanccctgatggtggnaagtttctccatcctgggtattgtggtcggctccngtattttagaagtagaaccagttccagacagaagaagagaactgaggcagaatatcaaccccagggtggatcaantgggttacaagtggttnaaaannnnnnnnnnnnnnnncnnnntnntntnaannnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 3487 - DNA, 657 bp, Homo sapiens
  Genbank Accession No. W28362
  unsure (1)..(657): n = a or c or g or t
tnnnntatctaggatgtggttctgttcatgctgctttctgcgatgtgcgtgtctgttagaataggctctctacccagctagaacaccttcgcagacacttgctggacagctatcttccacatacttcccagtttacatttggtcttaatgatcttgaatagatcctctcttcattttactcagccaggtttggtactgatgtacaggtgtnaaattacttcaagcatttnggnaagaggtgtatataattcaataaaaaaggtaaaacatgaacggaattcagcttggacttaaccaggntgaacttgnnggggggggtnanncagnntganctngtannggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnncnnnnnnnnnnnnnnnnnnnnnnnnnccc

SEQ ID NO: 3488 - DNA, 661 bp, Homo sapiens
  Genbank Accession No. W28366
  unsure (1)..(661): n = a or c or g or t
tnnnncggcaatgataatattcctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtntnnatttggngaaacaaaacaaaacaaaaaaaaaggntgggaactccancacgtggaaaaactagatcctgtgggttatngaattggngagtcctccacgtntgtctctctcgctcatgtaatntactctgaccctgagtggaangggttttggggcctgtnnnnattnnacctacatgtactatttagcttcagngtnctagncctgccacctgtgtttttttnngggtgctatggaaatnatgaaaggaacggggnttcaagaggaaattggnaccaattcancttgggttnttnggggttcaagnccaaagnggtncaaangncaaaatncnnaacccccggnaacccnntnntccgtnccgggngnnnnnnnnnnnnnnnnnttccccttngnnnnnnnnnnnnnnnnnnnnnnnnnnnnnnnnnnnnnnnnnnnnnnnnnnnnnnnnnnncn

SEQ ID NO: 3489 - DNA, 655 bp, Homo sapiens
  Genbank Accession No. W28414
  unsure (1)..(655): n = a or c or g or t
cggtcagganaggcaggcacagggtgtgattctgtccttgnaaggattactctctctggaggacggctggagtaaaatggaaccccaaacaccagatatctctctagcaatgctgagtgctagcatcatgtatgcttgtgtgcttttggnttgcaatgaggcctcctacctggctgaggtatttggacccctgtggattgtcaaggtttacagctatgagtttcagaagccctcactgtgtttctgctgccctgaaacagtggaggcagacaaagggcaaaggggtggggctgcgaggccagctgaccaagaaacccctccagctcctccagtccaagtccagcatcttttcctacaactattctgccttccacttcgtcttcttccttggctcactctatgtcatggntacccttaccaacttggtncanagttgggtcaaggggagttgtccagcccaggtcaataccccaaggaaaaaagggngtttctccgtagagtngntcaatttnaatggcnnggnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncn

SEQ ID NO: 3490 - DNA, 671 bp, Homo sapiens
  Genbank Accession No. W28696
  unsure (1)..(671): n = a or c or g or t
nnnnnnnnaatttcatgttcacggtagtatgggtatattaagtggttcatttccctcctgaagaaaacaacttctttctgatgtgattttgtgaaattcaaacatgactctttgactgtttaaaaaaaaatttttttttctttacgtntcttggtaagatttttttttnctgggaaattttttggggaanccnccaagtggttgggaaanantggcctnttggntcatcccnctgggaanagccttncagagaatttntcccacctgtnctgaaaantctgtttccccaggnggnggnggggccactggttagaagggatcanagagaattgaggggtgagcgagnttggnaaactactnctaatcctctccatnagtttgntatgacccaccccagtttntgaaaggnnagaaatgaaagaaaagtcctgggccaaaaaagaagagtggattncagttgggnttanccagttgacttcccangggggggttnncccannnttnatgcnaaannnnnnnnntnnccccangnttnnnctntgccaaaannnnnttnnccanntttnnntttgcaannnnnnnnnnnnncnnnnnnnnnnncnccnnnnnnnnncnnnnnnnnnncnnnnnnnnnnnnnnnnnncnnncnnnnnnnnnncnnnnnnnnnnct

SEQ ID NO: 3491 - DNA, 782 bp, Homo sapiens
  Genbank Accession No. W28798
  unsure (1)..(782): n = a or c or g or t
agacgattctcaagacagtnctctnangtggnccagggtaagccaaaagattgaacagtcctggaagctaaattctctaacagctttcaaatcctatgactcttctacttctcaaggtgtgtggtcttccactggcttgagtcatctcttcccaggaaagggtggtgccgtccagccagnacatccccagtggtgttactggatgcagnaggacttggatgtagttgcaccccctgggctggggtttccccccggttgatttcctgcgggtgctgacttggccgactgctgtttctgctnctcctcctcctgcacctacatcttggcatcgnactcatcagcaagcgccttccactccttgcgattgttggngatcccgnccaacattggggtgatctcctcggggaaacgggaggaattcagcttggccttaaccaggctgaactngctcaaanggnnttncccaggnttgaattcgctcacanagncttaccagggttganctngctcacaagnntnnnccagncttganccttgctcancngnctncncnannnttcnctnnccnccannntnnnnncnnncncncnnnnncnnanncccnncnnncnnnccnncnncnnncccnnnccccnncnnncnncnnnnnnccccnccncnccnnnnntcccncnncnnccnncncccnncccctnccncnncnnncnncntcnnnnncntnanncnnccccncccccncncccnccancncccnncnncccnncncncccccntntncnccc

SEQ ID NO: 3492 - DNA, 835 bp, Homo sapiens
  Genbank Accession No. W28824
  unsure (1)..(835): n = a or c or g or t
nnnnccccncccnnnnccnnntcttctagtttgncgattttgtcttggcttggngatggcgcggcgtncgtgttcgagttctctgcaggtcactagtttcccggtagttcagctgcacatgaatagaacagcaatgagagccagtcagntggactttgaaaattcaatgaatcaagtgaaactcttgaaaaaggatccaggaaacgaagtgaagctaaaactctacgcgctatataagcaggccactgaaggaccttgtaacatgcccaaaccaggtgtntttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttggaaactctggtggtgacctccgaagatggcatcacaaagatcatgttcacccggcccaannangaaaattgccataacactgagtngatccagtttggcttacatgactgcaannnnnnnnnnnnnnttnnccacnttnnntccanannnnnnnnnnnnnccncnntnncnntnccaannnnncccccncncccnntnncnccccnccnnnnnnccncncncccnnnnccnncncccncnnnnnnnnnncnncncncccnnnnncnnccncnnnnnnnncncnccncccnnnnnnnnnccnncccnncnncccnncccncncnncnccnncnnnnnnncnnnnncnnccncnnncnnnccnncccncccccnnnnncnccncnccnccc

SEQ ID NO: 3493 - DNA, 748 bp, Homo sapiens
  Genbank Accession No. W28944
  unsure (1)..(748): n = a or c or g or t
tttgacggtctcaccntagnataccgcgaggttgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgncggaggccatcgaggaagtgaagaatggtggctggacctcgnggaagcccctctggctgtgtggctatggactcacgcagagcactgtcgggnatcatcggnctggggcgcataggcccaggcccattgntcggcgtcttaaaaccattcggtgtccagagatttcttgtacacagggcgccagcccaggtcttgaggaagcaggggaattccaggcagggtttgggncttnccctgacctggntgccccantcttgatttcatcgcgnggcctgntccttaacaacctgaaccgagggnctcttgaaacaaggnnttcttccagangntganggnaacaagttttttncatcaaaaatcaagaaggggggaggtgnnaaaccaggcgacctgtcccagccttggccaagtggtaagnttt

SEQ ID NO: 3494 - DNA, 150 bp, Homo sapiens
  Genbank Accession No. W31382
ttttttccttgtataaattattttatttattattgtaattagatcttcacaaagttgtcttttcactgtgttttgtcaacgtgaaattaaattgtagttataagcaaaagttggttgcctagggaacaattgtatattcagtttaacaga

SEQ ID NO: 3495 - DNA, 311 bp, Homo sapiens
  Genbank Accession No. W31478
  unsure (1)..(311): n = a or c or g or t
aagattttcaaaatatttttatatagaaatttttttacaaagattttacaacatagcaaatcattatgtcatactgtagaaagatgaagcaaaggattaaactccaaggataaagaaagtgctcatagcaacgtattgcagtctccatgaaagtgcatataaacgggttaaggcaaagtaccatcttgggacagacatgtggcanccngngacttntaaaacaattttttaaaatatatacaaactttttttcttctattcttctcaaaggcatttgaaagggatacttttatgaatattcttggctgtag

SEQ ID NO: 3496 - DNA, 263 bp, Homo sapiens
  Genbank Accession No. W31906
  unsure (1)..(263): n = a or c or g or t
gtttccaattgcagatttatttccacacacacaaaaaaaatctatgttgaagttacaggattgccatgaatgccacacacctttcagactaagcagaaagcccacaagaaaagcacaaaatgaatgcactcagctgcccctgtcccccccaccctgggtgactggggaaggacaggcagagcatcctaacaggggagctgagtctttgggaggataggaaaagcccaggggtcagggnaaaccacacagaccntacanggggg

SEQ ID NO: 3497 - DNA, 244 bp, Homo sapiens
  Genbank Accession No. W32176
ttttttttttttacatttgcgttggcaatgtttaatgtttcacttttgcagaactgaaatttgtattcaaaggcacagaaggaaggaaaggcagttatcagagcatgaagtcacagataaaggatgctgaataaaagcataggactgctcctctttagccttaggaaaataaataatgcagtattaaactagatttttatttttattatatttccatgtgaagacatcacccaaatgtcagcgg

SEQ ID NO: 3498 - DNA, 432 bp, Homo sapiens
  Genbank Accession No. W33167
tttttttttttaccagtatagaaatttatttgaattcaaaataatatggctatatttataataatataataattatctaaagcaaatatcatcattggctctgaaatgcgtctaaagatgtcattcttaagtcaaaaaatacgtagaagaatgtacaagaaagaaaaaaatataaaaacaagtctgctgagtgtcgggagttggtgagggatatcctaccatattgtgacggagccaaatagaaaacatgcagcaacagttctcctgctttatcagctccctggaaaataaaccagtaaccctggtagtgcagtaaccatttggttaacaggacaaacttcctgatggacacagatagtaattcactgcatttcccttctctaacttctctcttcacaccaattccttttctttcctttaagatgggtttct

SEQ ID NO: 3499 - DNA, 414 bp, Homo sapiens
  Genbank Accession No. W35309
agcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcggcgcttgggcgaagcggcacaccatggacct

SEQ ID NO: 3500 - DNA, 378 bp, Homo sapiens
  Genbank Accession No. W36290
tttttttttttggcagtgagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattccaaaaaaaaaaa

SEQ ID NO: 3501 - DNA, 514 bp, Homo sapiens
  Genbank Accession No. W37382
ttttttttttacaaaacaaaagcttttttttttttagtttgtttcacagtatctaaaatggcagagatttcaggaaagtctaatcacacttgaccatgagtgttgagttgcttttccttcctctgaggccaagagttacttatatccaagaccgtgaagaactctttttgacctgttggatatgatcttgtgactgggtcgaggaaaatgaactcccagggttgttggagtagagctgtttccaccaaaagacagaactgtatgcagctaataagagctccagcacagtgaagatgagcatcaccacttaggacacctgttaaactgacactggtcagggagacaatctttgatttcatatattcggataatagtactccgaataaggcaatgaggatagataatccatttctgagccacaatgttgagagggcagtcctcaggggctaccatgctgtcagcaaggaggaagaggcctggctcctggcggttaacaggaactccctggcatttg

SEQ ID NO: 3502 - DNA, 376 bp, Homo sapiens
  Genbank Accession No. W37680
  unsure (1)..(376): n = a or c or g or t
agctcatcagctatcgttagtgtattttatgtggcccaagaaaattcttcttcaaatgtggcccagggaagccaaaagtttggacacctgtgatttacaggttatgcctagatctgaaacagatccccatccctcctaaagctcgcccactggttatgggccctgtttctcttagaaacaccacacacatcatttgggaaaagcacactgagtagaaacatggcctgaaagggtggtgggcggtggacctggcttcctgtggccagaggtcagcggacgatagaaatggtctgatcggccacagcaaagacttgggaagattgggccccgggaaggacacattgattgggcacagagcactgtgccggacgngggc

SEQ ID NO: 3503 - DNA, 515 bp, Homo sapiens
  Genbank Accession No. W38407
  unsure (1)..(515): n = a or c or g or t
ctctgtcgcccagggtgctggagtgcaatggcgcgatcccagctcactgcaacctccacctcctgggttcaggcaattcttgtgcctcagcttcccaagaagctgggattacaggcacatgctaacacgcctgtatattttttgtagagacagagtttcgccgttgncaggattgtcttgaactcttgggctcggtgatctgcctacctcgacctcccaaagtgctggaattacaggtgtgagccatcacgcccggcccacttgaatatatatatatagccaagaatagttgggctatactttcatctttggcctagttctaagtaattgattggtttcaggatccaataaactctacaggtaaatccactaaggtaatggtctataccggtggttcctgaacttgagtgtgcagcagaattacctggaaggcttcttaaaacacagatttctgtccccacctcccaggatttgattcaggcgggctgctgtggagcctgagaatgtacatttct

SEQ ID NO: 3504 - DNA, 432 bp, Homo sapiens
  Genbank Accession No. W38778
  unsure (1)..(432): n = a or c or g or t
aaaccatttgactcggtttgcctccctgcccgttgtttaaaccttacaaaccctggataaccccatcttctagcagctggctgtcccctctgggagctctgcctatcagaaccctaccttaaggtgggtttccttccgagaagagttcttgagcaagctctcccaggagggcccacctgactgctaatacacagccctccccaaggcccgtgtgtgcatgtgtctgtcttttgtgagggttagacagcctcagggcaccatttttaatcccagaacacatttcaaagagcacgtatctagacctgctggactctgcaggggggtgagggggaacaagcgagacctttggggtaatganttaacaccccatgctgggggatgcatggaaggtgaaagggggccagggaaccagttggaagaattttccaatcc

SEQ ID NO: 3505 - DNA, 436 bp, Homo sapiens
  Genbank Accession No. W39183
acgatccgtaactacccagccacagtgcatggtgctctgctgagtgggctgcgagaaggggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtggaaataacatcatctttagtcccttgggtgtgtggggtttg

SEQ ID NO: 3506 - DNA, 258 bp, Homo sapiens
  Genbank Accession No. W42429
  unsure (1)..(258): n = a or c or g or t
caatgaataaacatttattgagcaccggcaaatcccagacactacagaacacacagaaggcatggcccacgccgagggcccagcccttagcaaagctgccacgctgccaaaaatggtggcgcatnagctcaggcgcaggctgaggctggggcttggcgggcagtgcacttggaacggggtcctaaggcctctgccaggttccagctggggcaggggtcacgtcgcttcctgagagcagancaaataaataatggagag

SEQ ID NO: 3507 - DNA, 374 bp, Homo sapiens
  Genbank Accession No. W42483
agcacaacactcatcttttatttatttattatttttttttactaaggcacatgacgtagaaatattgaggtacaaaatgcaaatttctgcataagatttttaagatattcattttggaaaatgaaggtgaacatcatctcccagaatattcagcttttagcttgttttttcttttggaccagttcaaccagcaacttgtacctagcgatacagtcttccttgctcttggacgggacacatctggctattttgtcccagcggtcagaggatccccttgggtactgctgcaacgccagttccagaagtttctgttgattttgagtccacggctcctctgcagaccgagctctctcttttctcaggctctcctcgtc

SEQ ID NO: 3508 - DNA, 369 bp, Homo sapiens
  Genbank Accession No. W42627
  unsure (1)..(369): n = a or c or g or t
gtggcaacacgtttaattctgtggccatgctancctgtctccaaggcctggtggacagcacgtcaccagaggctgccgcagancaggcagggccagccctgatagaggagtgcaggcaaaggcgggggctctgaagtggctnctnggaggcnnatggccccgggctgggagtgctcagtagccgtcgttagcccaggtgacctcgtagtcggggtacttggctttgattttctcagttgaaatggcgtgctgggcaggaccataggccantggaatagccgtacacgtgaatcttcttgtcctgactctggttgggagatgcgcccgccgcccagacactcacagttcgcanccttngcttctgcatgt

SEQ ID NO: 3509 - DNA, 365 bp, Homo sapiens
  Genbank Accession No. W42674
  unsure (1)..(365): n = a or c or g or t
aacatattgatacattttattacaaagaaactcacacataaatgatttgtcctatttatcataataggccaccaatcactaggagccaagcttcatcagcttaagtcctaggtagcatgtctcaatgcatacatatttatatcgttattaaccgtgtttcttttctttttttcgagacagagtgtccaggctggaggtgatctcggcttaccgcaacctccgcctccgggttcaagtgattctgccgcctcagccttcctgggtagctgggattacaggcacgcatcaccacgcccggctacttttgtatttttagtagagatagggtttctccgtgttggtcaggctggtctcgaactcccaan

SEQ ID NO: 3510 - DNA, 383 bp, Homo sapiens
  Genbank Accession No. W42778
gaaaacaaaaatttattgcttctccttccaaagctttgtgaatttacaaaaaaaaggatgaaagtttacaaactgcttagttccaactaagcataagaggtgagaacgtacactgcagggccaccagcagcagctgtgcactcgatcgttaaaactggctcccccagacttgtagtgctgtcttcagggggctgcattccttacacgccacctcttgtgacataggtcattggtcaagccgctggaatgctacagaggtttttttggttttgagaggcttttttttgttttgccttcctactataaaagcgaaattttcagttcatttctgaaaaataaattggtcaataaattcattttgttctgcttctactttacacaaa

SEQ ID NO: 3511 - DNA, 257 bp, Homo sapiens
  Genbank Accession No. W42788
acagcataacagggtttgtttactgtgccacatcatcgggtgtttttaaaacgaaatataaatatatggttagggatagcatttttaggagaacaagtgaccaaaaactaagttacctcttttcaggtcagccaaaaaacgtgaagggaaagtggactttatacaacttagacatttatgtagatagcacagcagactcatgttcaagccagccacctgaaacattataagtccgtcgagggggacagcaatctatg

SEQ ID NO: 3512 - DNA, 398 bp, Homo sapiens
  Genbank Accession No. W42789
caaagtttacaataatttattattgttgcatgacatttgccagtaaaataaattatagaaactatagagtctttataaactattttgtatatcatattcacttcctaatgcttactgcagtaactgtatgaaatttaattagattacgttttagcattagtcagaagatttaaaaaatatgtaaaatgttttcacagtactttggatttataaaagaccccattattttaacttttgtgcaacctgtttgaaatgtataaaaaaccttttacaaaccaaaaggtggcgtaaggttttactgagttgctgaagacatcttactttcttgaatttctacttaaacatccatgtggtgcactttttcaggcagtgtaataagtggcaaataaataatcaat

SEQ ID NO: 3513 - DNA, 409 bp, Homo sapiens
  Genbank Accession No. W42957
  unsure (1)..(409): n = a or c or g or t
gaagagggataaaaatgttttaattgttgaaatacattggtgaattgagtaacttacattgcaatactaagtagatacacaagtcattatcaaattaatttccagatatcccactaaccatccatcgcaagtccttgaaaagttatagaaataatatgatgagattgtcgtgatgtagaatgagcaacccaaacagctatgaagtatttgtagttgcacatgcctttcacgaaagaaaataaaaatgtaatcaaaatgtgcatatggcatgcaaatttgagtttatttttaaatagtggcaatgaaatacaccttgttcctaaaaaaggaaattctgacatttaaatgaaatttgaaaaccaaatnagtaagaaatggaaagagatagttgtaagaatccatttaccat

SEQ ID NO: 3514 - DNA, 435 bp, Homo sapiens
  Genbank Accession No. W42996
  unsure (1)..(435): n = a or c or g or t
ttttttttttttttttttttttccagacgatacacattctttttattgcattttttaaatttgaaaataaatttaaataaataaacagaagtgggatcttgctatgctgaccagcctggtcttgaactcctagcctcaagtgaccctcccatctcagccttccaagtgctaagatgacaggcgtgactgccacacccagtctgtgcaaagtcctcttggtccctgcccctgggncccttccccacgtcaaagccaggactntggaaagggggcagacgtggggctcgcgtgcctgcagnnaaagngttcacatggtccatcgaggtccaaggagcccagggacagcctagacactgtggagaaggggccttcactgtctgacccttgggtgggccccatcagccctgcagcctggatggggtgggtcctatcaan

SEQ ID NO: 3515 - DNA, 160 bp, Homo sapiens
  Genbank Accession No. W44557
ttttttttttttgatcaagaaaacaaggggaaaactgaaatttattgaaggcttacatactgttaagagctttacaaacattctaccttcacagtctttaatggagcaggcaattggggttacatagcttgcccaaggtcatgcagctagaggtggcaga

SEQ ID NO: 3516 - DNA, 469 bp, Homo sapiens
  Genbank Accession No. W44733
ttttttttttttttgagtttaaattttattttacaaaaagagaaataaagaaaactgataggcagttatactgacttacaattgttctgtttgcttttttttaaaaaagtgacatgaaacacaagtaaaaataaatacgtcatagaaacagccagttgcccagtctctggggcaggagcgcctgcctgctgagaggagggaagcccatgatcacaccagcagctggatcacccagccacagatgctcctcgaagccaggcacaggtcccaggcctcaggggcgtcctgaggaaagaagacggaaaaccaaagccaggtgccaggaccctggggccacctcattatcccccactcctcctggcagcagtctggtcttagtggttatccatagcgaccccccttaacccacctggaccctcttcccctgacctctctgaagatggtacaagggaaaaacctgtcttgggca

SEQ ID NO: 3517 - DNA, 459 bp, Homo sapiens
  Genbank Accession No. W44745
  unsure (1)..(459): n = a or c or g or t
ttttttttttttagtatgtgctaattatgaattttattaaggtttattcaatgtcacagaggaaagaacggtttgtagttttgcttacccgcagtgctggcaggtcacagctgtccaaccatgatccattcacatgctctggccccgtgcccctcgtcctcccacccctaccccacaggacaccattaagccagggctgggtaacaacatatgctcaatgcatcttctcaggtgagaaccaaactcgagccacaacagcaaagggggaaaaaggtagcaaagtaattatgtgctcccaaggcagtcatttagttgaatccataactggaaataaaaaggcatttatgaagtgtagtcccgccagtctggaatgttggaaggtgggaagatcacacatttactaaggaaacactccaaacatantttgggtcagaattcntaaaaaatcccggaattttc

SEQ ID NO: 3518 - DNA, 460 bp, Homo sapiens
  Genbank Accession No. W45051
tttttagaaagtatcttctctttatttaagttaaacaattttcaaggatggtttccatctataaaatggacaaagtacaagctctgtacagcagttctttttaaaaatcaactggaaaaaaaaattaccaaactatattttgaatttgcaaaacatactcacagataccatcatctgagcttttatgaggacataagaaaggaccagcacagagaagacaactaacttcggcacgctttgctcgaagggctcttaggaaagaattctgagttttaaaaacaggagtgggagggtgagatagtcctgatgattaaaaactaacgcaaccgcagtaagtcactttggcacactgtgtcatgtaaacatagctcaccgcaaaggacccctccccgggcccacccctgctcttgacgcccggaccatccaaagccgcctcccagctcagggacaggacgccgcc

SEQ ID NO: 3519 - DNA, 460 bp, Homo sapiens
  Genbank Accession No. W45259
tctcaaaccgacagtgtgctctgtgacccaaggcaagtcttggagcctttcaaggctcaatttcttctgtaaccttgtggtttcacaattgtcaaccttttgttctgccgaccattgtcgtcatagtcttacttgcagagggcatagtgctgatgggacaagtgacatgggtatgagccccatgtaaactaaaacataattacctttcctttaggtgttggctacagttatcccaaacttggacttgaggtcttgtatatgcatgccattggtcacataccatcagaatagaattctcaaaaactctttagtaaataagataaacatcctacttataacagctcattatggattttatttttattgtctggctctttcagaccccagcaactgcaattctgacttaataatcaattgtttctaatcattaaaaatggtatatagaaaaactgaaaaaaaa

SEQ ID NO: 3520 - DNA, 309 bp, Homo sapiens
  Genbank Accession No. W45320
  unsure (1)..(309): n = a or c or g or t
gtgaagtttttattaaatccacagaagtaaaaaccatatcntgangaactgggggatgggnccaccagggagtnggagtcaggccaccaggggagtngggatggngtgacaggacagagaacagagccaggctgggctcggccatgggggctccagctcaggggccatcaccagggccaccagacagctcctgggaactcaggccagcaccaggcaggctcatcggcgggggctccaccagcacatgcagagaacttggtntcacccgaagcctccgttcatgcgcgtctcgaagaagcgctgcaggcc

SEQ ID NO: 3521 - DNA, 232 bp, Homo sapiens
  Genbank Accession No. W45487
  unsure (1)..(232): n = a or c or g or t
tttcaccagcagcgtcttccctttatnttagtttattaatagaatacagagtgcaggcacttacagtggtcaaactgagcgaggagtgggtgaggtctcctcagagagaggccgccctgggccacccatcagggaggcatgggcgggantgagaggcccccaagaccccccgccaccaccacccacatagcccaagcccagccaccctgggggacccaggntgttttttttt

SEQ ID NO: 3522 - DNA, 408 bp, Homo sapiens
  Genbank Accession No. W45560
tttttttttcagatcatattcctttattacatatatgaaatataaaaacaaattaacaaagcaatatatatatatatttgcaagtccacaggcttcagagaaaaaaaggttctgtatgtgaaattattcatatggcactgtgttcatgttttgtatattcaagtacaaaagaaactatgtatagtggttatgcgtgggtacagaagatgaataataatgaaaaactgtgattttttgactatcacatacattgtgttaaaaaacaggtaaatataatgactattactgttaagaaagacaaggaggaaaactgtttcaatgttcaggtttaaatactaagcacaaaaatataacaaattctgtgtctacaataatttttgaagtgtatacagtggcattgccaatgga

SEQ ID NO: 3523 - DNA, 493 bp, Homo sapiens
  Genbank Accession No. W46286
  unsure (1)..(493): n = a or c or g or t
ttttttttcatttatattctttttattttatcattactttcagattcagggtctctcgctattttgcccaggctggactcctgggctcaatggatcctccctgcctcagcctcctgagtggctgggattacaggcatgcaccatgccnggtgctacaaatttttttttaaaaaagctcggaaacacaacgggcttgcatcgtgttggcagcaggtgcctcttagctggtgctggacagaaggggcttgcagtatttgcactgaatccaaacccggtacattgtcagttgcttccctcggttcacctgcagtcggcggtccaccaggttctgaactttttccagtccagcagtggtgaaaagcgtgtccagttcctcttgtgtgaagaagtaaactctgggttccatcacctctcacatagaaatttccagatagacactgaccttttttaaaccgnagctgagccatgttaaaagcgggccggaatctccgca

SEQ ID NO: 3524 - DNA, 445 bp, Homo sapiens
  Genbank Accession No. W46391
tttttttgaattgttcagtgcatccaacactttacttactccacacctttctgcaaaatgctcataataaacctcctgtctacattgtgttccaatgaaaactttagtcatattttacatttattattaatataacatgctatgtaaatgtacaggagcctgacaaatgacaatctacttacataatttaaataacacaagtgcttgctgcagtctttattagtacacagctttgttatggcttcttagaaataattttaaaaagtgcatgattcttgtgggctactctgtttaggaaagattacagataacacatttctaagaatgaattagtcagctgtatatgggttcagattagaaaatattaaataaatacagggaaaaatatttttaattagcttaatttatatatgaaaatattttatttaatttgtttttgagacag

SEQ ID NO: 3525 - DNA, 445 bp, Homo sapiens
  Genbank Accession No. W46404
ttttttttcaccaaactaacatttatttagctttgttccctcccatccaagactgctgatctctaaacaagcatcaaaacccgaagctcattaacatcagagtgagcttcaataaggtgaacactacaatgatgtacaattacatcctaataattcaatgcccaagagccctgtagaactattgcaaggcccaggattatcacagtatgcaaatgcactaggaaaatcattacctatttagtcccctttattttggtgggtttaacatgagaagaataatccatgctacaagacgagatttcattttacagctgtagtaaccaagtgcataaaagcttgaatctgtcccaatagcttctaaaaaatttttcccatagtgtcagaggcaaaaataatgaaatcttgcaaatgtacagttaataggaccctagtgggacactaactt

SEQ ID NO: 3526 - DNA, 442 bp, Homo sapiens
  Genbank Accession No. W46451
  unsure (1)..(442): n = a or c or g or t
tttttttttttttttttcaagagtagattctttattcatttctcttttttttcttaaaaaaaaaagtattcatttggtataaaaaataaatattttaaatatgacattgaataaataaaaataatctgtcagtatgaaacatccccacaggtacattcatcaaagaggaatttgtcacccaaggccatgtgcttttcagtggaaaggaaggagggaaacctctaaggccgcacggtgggcccacggagctagcacgtggncgggactgaaggctggatgccggcnattgaggtggggaactagagatgactctaaggcaggaacatcttgtaccatctngcagggaaatgctacctccccgggtgccagagctccaaccccacacactatgtctactctggagagccggcaagnagnagctgggaactggctgggtcagggt

SEQ ID NO: 3527 - DNA, 364 bp, Homo sapiens
  Genbank Accession No. W46634
gaaaccaatgcattctttattgcagactgaagcttaggggctcactcactgtgactctgatttgggggcatctgtggctgcccacactttccaagacagacaagggcaaactctccaagcagaggagaaaacaacttccagaagctgccccttcaaaggcctgaggtgaggacctggggcagcaggcagcttggcatgcaggggttaaccagaaaggccgggtctggagggctgggcacacctaaccctcatctcctggtgactgcaggtcccactcccttcttcaggagtgccatgcagactcttggaacaatctaacaggccaagtgtctcccagggtgggttagggaggaggctgaacaca

SEQ ID NO: 3528 - DNA, 437 bp, Homo sapiens
  Genbank Accession No. W46810
  unsure (1)..(437): n = a or c or g or t
ttttttcccagatgaggatttattggcgtaaatgcaaccatataaaaacataagttatgaaaaacacagtcacgatgtgccctccccatccccccagcccaggcccctaaaacccccttctgcggnnnnganggagaggaagggggagccccgaaaccgcctaggaacgctcagcccctgggtccgtgcagggcgggagagccgggcctcagcgcatccggtagtcggtggagcaggacctttcgcanaagctggcccttgaagtccaggtcgntngtgaantccaggtcccggttgttcttggcgttgggccgcattgccgatggtgccgaagatctcctcgcccgtcttcacggtcaggtaagtcctccatgtagaacaccgtcttgcttccagtgcgtgtacggggactcggggctgggtggaagaagncggta

SEQ ID NO: 3529 - DNA, 331 bp, Homo sapiens
  Genbank Accession No. W46846
tttttttttttttgcaaaatgaaacaagtttattttctccaataacttctgtaaattacaaagacaaaatactaaaaactacagcatataacttttcaatatttaaccagagtactcgtaataaatatgcatccggaaacaagataaaaggctacacctcgtcaggcatcctacaaaaatgtctcaagttttatatactctgcagcatttctgtgcgggggcagaaggggctgttgtgtattttctgaagtgctgtgacaaaaggtcctttcacatttctttggagcatttttgaaattgcttaactataattaaacaacttaagaaaagt

SEQ ID NO: 3530 - DNA, 430 bp, Homo sapiens
  Genbank Accession No. W46947
ttttttttgcgtatttcaagtgttttatttgctttctgtggtgtcaaatttggggtctcctagagcccagccccaggcagaatccggcatatccttctccgcctggggggcccgggacacaggagtttcagaaaaggcactggcaaaagttctagggcgggggtcagggagaagccacactgagcctggagggaccgggccctccttcggcggcagaaaacacagtcacctttggcagggaagggttttttcctagaaagaaatttaagacaagataaaaacctgagatgttagaggagcccccagaaccaagccggtgctcccctgggcaggcagagagtgaactcggcttccaaaggctcaggggaggcttgcccggccctcagccaggctcagatgccacaggccttggcaagcagaaagcctaatt

SEQ ID NO: 3531 - DNA, 465 bp, Homo sapiens
  Genbank Accession No. W47175
  unsure (1)..(465): n = a or c or g or t
tttttcaactgcaataaaatcagtgcagttcagaaaactcgacctttcagtatccgagaaggcagctttgtaagcactttctgttcgaggaactttgttaagcagctgaggggaatctgacccagctcctgtgttgtctggtgtagacagggcaccagactgggagtcaagtggcctgggtgcttcttcactgccaccagcacttcctaataatggcaaatttacattttgttacggtgctcacagcttacaaaacacatacatgtgcatcatcacagtttgttcacctgtaagatgaaagggttggattctttgttttctgtggtcttttccagttctagtgccttgctagtctgatagtgtgaattattttttattacagctggcgctgctgctgcatcagggccatcctttctgcaagacacaatgaccacagcaaagagcgggaaagataactttccacgn

SEQ ID NO: 3532 - DNA, 365 bp, Homo sapiens
  Genbank Accession No. W47206
ttttttttttagcattttatgacttttattttacatgtcgccaacgtttgtacaacatacagtggctacatctaaaactttgagcatttttttatggcgcaaagagacagaaaggttaatgacacacttaactgttacagtgactttgggtagggccctaaagacagcacacgctccagagggcgggctgagtgttgttcacacttgggtcctgaatcgctgttgtaaggtacagagacacactttaactggggaatggggtccccacacagtgatcgccccacgggagggtgacagaatatgccaggaattgtcttggacatgggccccagtcaccacaatcagatggcttatttcctcgtgcc

SEQ ID NO: 3533 - DNA, 466 bp, Homo sapiens
  Genbank Accession No. W47388
  unsure (1)..(466): n = a or c or g or t
tttttggtgctaaaatccattccatagctttgaagtgagaacttacagcccatctgaacagtgaggtttgtacccaggcatactctgaggagggcccaaaggcacgcccatctgggagggacaggcccggagatggagacctcgcagcatgtgcaccctgcgcagacatttacagacacgcaactcagtctttctcacttggacaacctgttgtgcaaaaacactaggaatcttgaagtgagggagctctgtccacagctcccgtaatggcagggaggagagcagagcccaatgaaccttgagtgaaattaagtgctaataaccacataattaaattgtgcagatcagcagtcctagtctggaatttaaacactgtcaacggggcatattggggaaagatatttatatatatatacattacacacacacacacacacacacacacacacacacacaaacacattna

SEQ ID NO: 3534 - DNA, 422 bp, Homo sapiens
  Genbank Accession No. W48860
  unsure (1)..(422): n = a or c or g or t
aatnggcaccaccgtttattgctgccagtctatctgaaattccgtgagtctttctgggtttttggagataagtgcaccagagttaaattaaatcatttaatttccaggagtgataggcatagggacacattactcaaatggatctggaatcccatttttttccaagaaatctttcttgattcattggatgagtggctataatggacatatcttcctattaattgccaacagcacccccagctcccaaattcattcttttgtctatgtgtagaggtaacagcccttatcagatgttacatttgtttaattcggtgactgtgtggctgtgatttaatctaagtttccagggagctatgggttagatgccaagctcactaccttgagcagacagggactgctggagaggagggtggggtgagctc

SEQ ID NO: 3535 - DNA, 443 bp, Homo sapiens
  Genbank Accession No. W49574
  unsure (1)..(443): n = a or c or g or t
ttttttttttttttttttttttttttgaggctaaaatcatttaattatacacaggccacaattgcaggatggaaaggcagtgggcacttggaagtgactacacatggcaataagcagcctatcttctttaccaaccagaagtttcttggggcatgtgatggtaggccagaccctttccaagggaataatactacactaagcctacactgtactgtgagagtcatggtggaacaaggccacaggangtgggacggaaatgtgatgactcactgtgtcagaattctaaggcccagcatgatcaggatgtaaggctccataattttctaaaccagaaattatgagaagaacaaaattctggcaatcacttatgtttttttcttcttttttttttttgagacagagtttcactcttgttgcccaggctggagtgcagtggcacaatc

SEQ ID NO: 3536 - DNA, 386 bp, Homo sapiens
  Genbank Accession No. W49661
tttttatcattcaacattttatatcagaaaagatcagctttccaacatttattccatggaatgagtgcacagcattttcatgaactacctcagggctacatcagtacaaaatagtttaaattagtaaaataaagtagtttcaaagggaaatcattcgacgacttcaggataagtgccaccaccatttgggaacagaggatagaaggtagccatgtggttattccatgatgcaggaatcaggtcggcaggtggactgtcattgctgtcttgcggcactggcctctgccttcagggtaccaccgtctccaggacacaaatgggcagcagaaaaatgtcaccttgttgatactcagcagctcatctattgggacaaaacttccatctcg

SEQ ID NO: 3537 - DNA, 469 bp, Homo sapiens
  Genbank Accession No. W49743
atgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggacggccaagcactataaatcccctacgtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcatta

SEQ ID NO: 3538 - DNA, 404 bp, Homo sapiens
  Genbank Accession No. W49791
gccttgaatgaaaaccatgaatttaatgtgacattgggggagcctcatccttccctttttaccacccacccatccagcctgttgtgagttgggtgagggctgcccccagtctccgtcctgcggctctcgggtgccatcctgttcctttcgagctcagtcagcctcctgggctcgtctctctgtgaatctccttcttgcgtattcatatagtgcttgcttgcgctcctgcaggctctcctgccgggcccaggaagacttggcaaatgttagggctgttggctgaggggtcaccgggccagagctgggaaacttggaggcagaggctgtgggtagggactgagttcccttggtgatgtcttcaggcatgaaagctacggccccctcaagcagattagtgatagtca

SEQ ID NO: 3539 - DNA, 541 bp, Homo sapiens
  Genbank Accession No. W51951
  unsure (1)..(541): n = a or c or g or t
ttttttttttttttttttgaagatttgaggctttatattctttagatgcctacttttgccatactggctagtaagaagttatgtgtaacttcaagatgaaaggcattagcaacctcttagaagacgataatcccaatcttctggagattgaatgagatgtaactcactgaagcttttgactcggtctgctgttaattgaatcaaagtcaatgacaatcttgctgcacttcggtatgaatttccggaatgtcaccccggccatattaaacaggagcctcgcagcagttgcctcgtcactatcatggtatttatcagacatnaaaatcacttcttttatacctgcctggatgatgagcttagcgcattcatttacaagggaacaaggcgacatacatactacagcctttcacatcggtcgaatttttggttcatgatggcattcagctccgcatngcacacgtacgggnanttggtgtccagcttaatctctgcngtccttctccaaggnacacgtcatcaatggacccattggnatccattg

SEQ ID NO: 3540 - DNA, 361 bp, Homo sapiens
  Genbank Accession No. W52581
aatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctgggagtacagtggcatgatctcggctcactgcaacctct

SEQ ID NO: 3541 - DNA, 564 bp, Homo sapiens
  Genbank Accession No. W52821
  unsure (1)..(564): n = a or c or g or t
tgtagattgccagcttgctgatcgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatngaaatttgtatgccttgatttttttttcatttcacacaaagatttataaaggtaaagttaatatcttacttgataaggatttttaagatactctataaatggnttaaaatttttagaacttcctaatcacttttcagagtatatggttttccattgagaagccaaantggtacncagattggtgagccagggaancatgg

SEQ ID NO: 3542 - DNA, 511 bp, Homo sapiens
  Genbank Accession No. W52858
cacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaacccgaaatttgttttatgcatgagttaataccactggctcagcaaatacaagttagtttgctttaagcaggtaactttttttgtaatggaacgaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatggtaaacattggtcaagctgtgaaagaaaatgggctggaggtgtgctttggtgtggaaagggtgagcaataaaggtatccggttaagttccccaaaaaaaa

SEQ ID NO: 3543 - DNA, 577 bp, Homo sapiens
  Genbank Accession No. W55903
  unsure (1)..(577): n = a or c or g or t
ctgacagctccatcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctggtactgttgtaatgaataaaaacatcttcatgtgggctgggggtagaaactgggtgtctgcnctggtgtgatc

SEQ ID NO: 3544 - DNA, 400 bp, Homo sapiens
  Genbank Accession No. W56642
aaaataacaacaaaatgtatttaaaaacagacttctccagttggcattttgaatgaaattgctaacaactccaaccctctatattgtgtttcttttgctcctggagtcctcttgcagctttaattcttgaaactcaggcggcaaccagacattaaatccccaaaggagaggtattagtaaaccttttgctggtcattcttttccgaatgcaaatggacaaattcttaagccctcttattcatttcatgatgatcattagataaaaaaattaagcctaacttgcatattgaaaataaaaacaaaaacacacacaaaaaaaccttgcagataataaatatcgcttattcacttattttaaacaaagtccaattttattcactctcaatatccttgcagtcca

SEQ ID NO: 3545 - DNA, 251 bp, Homo sapiens
  Genbank Accession No. W57821
gtagagatggggttttgccatgttgcctaggctgatctcaaatccctgggctcaagcaatccacccacctcagccttccaaagtgctgggattacagatgtgagccaccacctacagcctggccaagaacccttttctctcccacattcccctgggagcagaggataggcctgatgattgttttaaacagtagaaagggttcagctaagaactacagtccactctcagccctgtcatgtactataggacaa

SEQ ID NO: 3546 - DNA, 426 bp, Homo sapiens
  Genbank Accession No. W57931
  unsure (1)..(426): n = a or c or g or t
tttttttttttttttgggaggcaggagttgctttttattgacttggaagtgggctcttcagtgaagcccctttggttntaagagcattttcctgcttcctttgttcttcctgcaacttctgctgcctgagctgccatgcttgtaatccagcgtccatttcctgtgacagcagtacaactcgtcttgcaaacgtctccctttcagcttttcttcgaagctggcctttcattgggggagcagggcggccatccgattatgaccagtctgggagctcggtaaggggcccgtaagccggangggttggcagccaagtccctgctgtantcgccactggccgcccgcccaagcggttacnttgcagtgcacccttccggacacctgtgaagagaacagtccctaaagcagccatgtgagcagcctcgtgcc

SEQ ID NO: 3547 - DNA, 469 bp, Homo sapiens
  Genbank Accession No. W58081
aaaatttactgtttatttctttgttacacaaaggtggtccaagacatcttagtccatctcctatgtccttttggccataattacacacacaataatggcaagctagattaggagtctagctcagggtcaagtttttccactttaatgactatctctggagctaaagcggcagacccagcttgttggttctctgcctctgactccgacaacacttcttcctttatttttacaggcttattactggcctcctcctcttcatctgaagactcatcgagctcccattcatcatctaatgtccatttcaaatactctcacatgaccgaagatttgaagcttaacacacaggacacttttcgaaaaccattcccagcaacatactgtgctttcatactttccagtaatctccagtggcttctcaaaatgcatgggtaacgggtgggaatagcactacactggttcatctaggcct

SEQ ID NO: 3548 - DNA, 470 bp, Homo sapiens
  Genbank Accession No. W58247
cgaaaaaaggaacaaagcgttactgaaaagaaggtaacctttgttggatgtgggccttagctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtcaaaaaaaaaaaaaaaaaaa

SEQ ID NO: 3549 - DNA, 357 bp, Homo sapiens
  Genbank Accession No. W58520
  unsure (1)..(348): n = a or c or g or t
atatagtagtacctttcagaactcacattggcaagtgtaaaaagatgacttaaggtgaagtgaggacaaaatcacattctgcatactaacctatttttttctccctttaaggtgctaaacttgcacctcatgtccactcagtaacaagtattgggacgtagagcacagcctcactcagctctgaaaggtaatacagcttgtgaggaagtgagccagcagtggcctttgcaattgtggatcttgagctctgctctcagcagatttcaggtgtaaccatttgttaactgtactgaaggtgtgtcctcaagaagaaagtgttcaaatttaaaaaagctgctngccaagtaaaaaaaaaaa

SEQ ID NO: 3550 - DNA, 494 bp, Homo sapiens
  Genbank Accession No. W58540
  unsure (1)..(494): n = a or c or g or t
cttcggcacaggtgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttaattcccaaatgccatactatgaagatcaaagtcttaagn

SEQ ID NO: 3551 - DNA, 525 bp, Homo sapiens
  Genbank Accession No. W58756
  unsure (1)..(525): n = a or c or g or t
ggtttagcaaaattgttataatttcttttaaataacccacagacacccatcgacacttccaaatttacagagcaaaaaagtgatttgcagctggttcctccagggaattggccccgaagctggctcagttcacctccaggacctcagtctccgggaggccgaacttggtcttgtgcttgtcgaagagcttcaccagggcctccatgtacatggtgtggtacaggtcgatgtcttgctgggttgggtgctccagcttggggatggtgatgggctctcccacaacagtgggtgatgggcttggagtagggcaccagcccccaaggtgtcggaggaagaagaggcctcgaccatggaagatgcatggggcgaaaccaatgtatttctnggaacttcttctgggacccatcggccccaggagccctcctcgaagatcacctgctttgtacactttcattctctcccaaagggggtagatgggaaccaggtcagctcccatgacgcagggcccagttttnaaaaaaagcc

SEQ ID NO: 3552 - DNA, 459 bp, Homo sapiens
  Genbank Accession No. W60002
ttttttattatgtaaatgcctttatttgaactactacattgctaccagattacatcacttttcagagttagagtaacataataccttggaaactatagcaaacagcttgacaaagcaagagtacattaattcctacatatatacttttatttttagtgaccacatttctttgtttcaggtgtaaaattaaaaaatatattgtacacttagcatacttggcctaccaaatcccgtctaagttctgagcacactctctcctcaaaagtatcatattcaacagcattttaaatttagagagagagtttgatgatacaggttttaaaacaaataagcatgtattgaaccaagtgatttaagacaaaatatttcaattgtttacagcttgggtatgagagggaagatgcaaatttaaggtacatttttcctctagctacgatggtatgttttacttacctggat

SEQ ID NO: 3553 - DNA, 428 bp, Homo sapiens
  Genbank Accession No. W60097
ttttttttgacttttgaactttttattttagtaaaatcagaataaacagagcacatgcagtgccagcatctaaaactaatacaataagcaattactgaacttttacagtgactcgaggttcaatgattacattcagcaattccattctttatttactcgaagaatactgctggctgataaaaccgaatgttaagtcactgacagaaataaccatgtttgaggactgtaaatataccagacaatcactgaaaatcaaacacaacaaaacacataacaaaactcaagagaaactttgtggatgtggacacttcctatcagtgttcagaagtgtttcattaatatcttaagacaagtatatcaaaaccttggcatgttttagtttcaagttgacaattttgtcttaaattttggtcagaaaattacagcta

SEQ ID NO: 3554 - DNA, 98 bp, Homo sapiens
  Genbank Accession No. W60186
aacttacaaacaaaaataccgtaataataaacccaaacaaagaccctcagcttgctgccacgttctctatgcggtttggcggggcgggtatttacaag

SEQ ID NO: 3555 - DNA, 431 bp, Homo sapiens
  Genbank Accession No. W60486
tttgaaaaattgacccgttttaattatttaaaaacaaaaaacacatcaaatttcctttaccatctacaattcagttatatccaaacactctaagaccaaacagaagcagggatgacaatgagacactgaagacacacgaaggtgaatgctgaagaccatcagagtcccagcaggaggtcacgtctttcattcagacgctccaatgcttttcatttcagtttgttaaagaacgtgttttacaggaagttctttacagtaatttcatgccagacaccaggtttcttcgatggtacacagctccatgaaatttgtgtttccatccagttgacaggaataaaaaggaatttttatttttgtctttttttgggccgtagagacgtaaaatggtcagattcctttaggaataaatgaggaaaaggagaggaaagaga

SEQ ID NO: 3556 - DNA, 439 bp, Homo sapiens
  Genbank Accession No. W60968
  unsure (1)..(439): n = a or c or g or t
tgatttaaaaaagatttatttacttgttgaatatttattagtagtagtagtaataaatataaccccgaagccacaaataaccttaggattctctcagctttaatggcagtagagtccagcttcttaatcttttgcacaaaatacactcaaggaggagctatccataagactaatagaagacttttgtctccctgacccagctcctctaatttcatatgggaaacacctaacagccataaagtgatgatctgggagtcctcattagagatgggctggacatgtcagaaagctgaagaaagaaatcaacctatttcgtgaaccttaccatctaaaattgttagtctgtgtcttctaaataaacagagacctttttctcttgggttgagccnttcccccttccntttggattttatctccaccacttttatggaggctcctt

SEQ ID NO: 3557 - DNA, 607 bp, Homo sapiens
  Genbank Accession No. W61000
tttttttcatttttgcaacaggcttttattacttttttttaaaacccatataagaaagacatttaaaaagaaaatatcctggaaacaaacacttacacactgagcaacacaaccaaagaaggcactaccagcagttactcccacctctgggagggaacaggtactcgatactatacttttttcagaggtttagacctcagcataggccttgggtctaactgtgctttagtaaagtctgaattgtccaataattttctcatttcataaacacccttatctctttatatatagctatatgcctttatgtgtatatatacatgactttttttttccttctcaaaaataaaatagccatccccatagagggaggttctcagcagcattcacagcggttgcagcaggagccatgccttctattaatgttagagacatgcaggacgaggaaaatgactctccacctgctccctttaatatacagcagggagagagttctaaagggagggaagtgataaggtgagcatgagatggtaaccagggttttgtggttaaaaaatctagagtgcgagctgtgtgccttgaaccctggagctatgccagtcatcgcgag

SEQ ID NO: 3558 - DNA, 321 bp, Homo sapiens
  Genbank Accession No. W61319
ggcagaagacaaaagcaggtttattagggccctgggcagcgaatgcctaagatatgagttaaggccagggcgtcgagaaaaggtgactctcctgaggccaaacctttgcatctcagaagccctggctggagaccttaggagtcagttctgggagggacctggggatacagaggggtctctcctgaccctgggatctttgggcttttgccaggattggggaaatgatctggggggcagggagccttgaatccacagccttcatttcaataacgaccatttaatttgttccttggcagactgaagaacctgggccacactctg

SEQ ID NO: 3559 - DNA, 458 bp, Homo sapiens
  Genbank Accession No. W61377
  unsure (1)..(458): n = a or c or g or t
ggcagcctggaagaggaacagaagcnggntcggggtggantnagaatactanncttagcttgagacattttgcaataaggaagctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattag

SEQ ID NO: 3560 - DNA, 436 bp, Homo sapiens
  Genbank Accession No. W61378
cagtagaaactgtacttcaaatattgaatttttattcaaaattctttataactttattacaatatagattttgtgttggatagttttgcccactgtaggctaatgtaagtgttctgagcatgtttaaggcaggctaggctaagctatgatgtttggtaggttaggtatattaaatacatttttgacttatgatcatattttcaacttatgatcatattttcaacttatgatcgggtttatcaggatgcaaacccatcacataaatggaggggtgtctataaaacattgttagacctataattttgctgttgattattcgggaggtggtatggcacagtggttaggggcagaggccttggagttggactacatgggttcaaatcccagcttggctgttttctgtgcagttctaatccagttctgccacaacctggtt

SEQ ID NO: 3561 - DNA, 327 bp, Homo sapiens
  Genbank Accession No. W63608
  unsure (1)..(327): n = a or c or g or t
aaggatgactcagcagggatgattcagcagagataactcggggatgagtcatccctgctgagtcatgtctgttgaggggcagtgctgagtcatccctgctgagtctgctgagtcatccctgttgaggggcaatgctgagtcatccctgctgagccatccctgctgaggggcagtgctgagtcatctctgcagagtcatgcctgttgaggggcggtgctgagtcatccctgctgagtcatccctgctgaggggcagtgctgagtcatccctgctgaggggaagtgctgagtnatccntgcagtnatccctgtttgaggggcaattgct

SEQ ID NO: 3562 - DNA, 444 bp, Homo sapiens
  Genbank Accession No. W63728
  unsure (1)..(444): n = a or c or g or t
tcactgtgatgaaatcactttaatgtccttgccaaggaaatgcccaagacactggcaggtgggcaagtaagtgtccagatgggaccccgcagctctgtctccactcagcagtgtccgcacgccccaggccagcaggcgncccctcctcgggcaacactggtcttcctgagggcagcccgtgctggggtcccacgcttcgtccatagtgcttgtggggtctctagaactcagtcatcttcttgtgggtgtctgccttcctctgctcctgctgcaggccggcttcctgagcccggagctgccccagctggcgctgggctcctgccagcttctcctgcagctgggctgacgccacgctatgccggccagcgttgcgngcgagactcctggatgctcctgatgtcccgctgggttcgctcgatcttctcctcagtctggaagagccgc

SEQ ID NO: 3563 - DNA, 519 bp, Homo sapiens
  Genbank Accession No. W63741
  unsure (1)..(519): n = a or c or g or t
tagtcaagcaattttttccctttatttttgttaaataagattccagaaagtatagtgcaaacactcagtagaaaagttgcaattaagaaatgtacattcacatttaacatttcagtccattcactttttttaaaataaaaataggacaaattattcaattacttgtctcaatttaacaatcttgaaaaagactggaaggtaccctacagtgttcagttgacataaaaatagacccgtattgatcatacaaatctatcatgagaagttacccagtgagagtgagttattgtaattctgaatgtactcatcgtgtttctcacttctacagaagcatcctcagtgagttgtattgtgcgagaaaatgacacccttgcccacatcactctccattccatagagggacacaaccctatctagccaaacccagaagaacgcaggcgcttacacaacttttctcggacagtcgagaaaatccaaaagtgggctttgggcttacttaaataggaatgganctcgtgc

SEQ ID NO: 3564 - DNA, 495 bp, Homo sapiens
  Genbank Accession No. W63785
  unsure (1)..(495): n = a or c or g or t
agtaattaaaacgttattttcttttctttaaaaaatggaactaaaatacgcttcctattaacttctaccctttgtcctacaccaattgtctaggaccatccaaaaaaacctaattctttttctatgttagaaatatttattaaatgcctaccatactaggcatggaatgaggtacaaagatgaaacaatccctttaattaggggtagaaagacaaaagcataaatttcataacagagctatacaaaatctgtagcgagagtaatcacaactaccagaaagtctgagaactacctcaaaataaacactatttaagatgtatgttgggagaatgggtaaaatatcagcagggtccagggtagaaataaaaagatactccagacattcctgggaaagagaacagcatacataaaggcaaagaatgacaaaaggcttaatccacctagaagacataaccattatnaatatattggcacctgaaaacaggcttaaaaaca

SEQ ID NO: 3565 - DNA, 422 bp, Homo sapiens
  Genbank Accession No. W67147
gcacagtcttacatattccagtcaaggtctatgaatacagaccctcaacaaacaggaagcagctttaaaaatgtatcaaattgctatagtcaattcctacactccagcttgtagttttctttgtttcaggattagacacagaacccattcttcaaggactcggcaaaagttctagaaacaaacaccatggtggtggaagcggttgcgttgcttcagtgatcacctagatttggtgtctttggtttcagtgttctggttactgaaggaatcccggatctttacaacttcagctgcacacaaatgtccaaaagattttgtgtaccattctggcatgtggccccttaaagtcaactctgcacatgtaggtgagtttggattttcctggcccacagggttcaatcaaatacctgggacaaagagca

SEQ ID NO: 3566 - DNA, 455 bp, Homo sapiens
  Genbank Accession No. W67199
  unsure (1)..(455): n = a or c or g or t
tgcattgacatttttttatatttggtatttgtaagtctttaaaaaaatgttttcaggccattttttccttaaaaaaaaaaaaaagcaaccaacagcaatactctgtacaagtataacaaacattagaaatatgcatcattccaaaatagttacaggaaaattacagtttagagtccacatcaacacatcctatttgtatgtgcccccaagggagaaaaagctacagtatgttaaacacacagctgctacacagtagtctgaaaacccaggacttaaaacttttgaggcaaatcaacaacagtcaccaagacttgtttangctcaataagtacaatcaagcatttcaaaagagaaccaggctttttcatcccagatgaaaaacacacgtgatgggctgcatagctgacccccgcccctcgatccccaacccccgggagcctctgactcaacagang

SEQ ID NO: 3567 - DNA, 406 bp, Homo sapiens
  Genbank Accession No. W67251
caatttagtcactatttattatattgacatatttacaaaataatacaaagtgaaataccactctaattcaccatattacacaagggctgcatacaggcaagacaaagtatatggaaaacatttacttctgtctttggtattagaactctacacaaatctgcagcatttaaattttccaaaacaaagtattaaacgtggacaaagatgtaattggtaatgtcacaaaaaggggctccaatatcctctgctaggaaacccccaggcccatgaaatgcaacaggaagactaaacaccatttataaggagagggtctattgactaaaataaacaatacatgctacaataccatccacaggagtgtttctgcttgtgtgaggctgctccctccataacaaagttcggctga

SEQ ID NO: 3568 - DNA, 413 bp, Homo sapiens
  Genbank Accession No. W67564
  unsure (1)..(413): n = a or c or g or t
tgtttcataccttttattacaaaaatcaataacttaattcagttctgtataaagtcgataggacttctggtccaataagcagcctaagctttcattctcatcccaagaagggacaggagtcttggcccagaggctgtggggaccaccaaaagcctcccaggcagctggaacactgtgtccaaaccaaggaagtccaatgtggggtgtggctgagtgaagagctgttcctaaggagccaagtgctgtctatacaggcttgcccctccaggagcattgggtcacctctggggatggccaggctgaatcagcactgccagcctctgcccacctgatctntgccctggggcttggaacaaggtcacctgaggcaaaaagcattgtcccccaaagaagggncagcgattttaacatct

SEQ ID NO: 3569 - DNA, 499 bp, Homo sapiens
  Genbank Accession No. W68721
  unsure (1)..(499): n = a or c or g or t
ttttaagttaaacacccatatgaatttattaaatccagactgtgttaaagggcggcggtctaggagggggagtgtggtagggggacgagggacaagatgatgaacggccgtggnatcccgtangggcgcccggcccacccccgcccaacccaccccctcggcaacgctgcatcagcttcaccatgattcccagtggtgctgggctggcagggcgagatggctggaaacacagagggacagagggacagacagcgcctccacaaacaaaccctggcctgccccggcccctacatcacacgctgggccctgacctgaggcgggcctcccaccgccccggccttgatctgtccagggaaagggcgacattggaggggaggcgagggggccgggacgcaggggtagtggtcgccaggaagccggagcaggtnaggaccagtctcgactaatcctttttcttgtcctctgctggctttggaggggctttcttggggctcgctgg

SEQ ID NO: 3570 - DNA, 473 bp, Homo sapiens
  Genbank Accession No. W69302
gctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaagccacgtttcatctttcctggatcactacagtgaagtattacacgttgtacacgttcccagtctggccttggcttgctcggataaaactttgtatgtattttgtatggcatagattctatattgtaatgatgtcctatgcaaaaagagaaattaacgaaattgtaaattttattgttttaacgtgtatgcatgtttagtgacgtttacattttgaaataaaattt

SEQ ID NO: 3571 - DNA, 476 bp, Homo sapiens
  Genbank Accession No. W69468
tcagcagcatttcacgctatttattccccaaaaccttctgccatagaagacagccaccatacagattggaaaatgtggacgaggagaaaaggggtgtatggtaagcaaaataaattgtattttccatccttggggaggataaaggaactctttgcactgctataatgaacagcccccaaatgccagtggtttaattcagtggagttcagacctcattcctatatcattgcagtgtggatgctcctggatgaaggctcttgtaggtaactctcctccagtcggtgattcagggacccagcctccttctgccttgcggctttgcttttaaaggtcctcagggtgctctccatgtatcttgccaatggggaacgagtgtggaggactcacaagcgggtctcacatcacgtcctccggggctaatacacatcccttctccccacactctgttggtcagaagtcactgcttggcgccctgc

SEQ ID NO: 3572 - DNA, 445 bp, Homo sapiens
  Genbank Accession No. W69675
  unsure (1)..(445): n = a or c or g or t
ttttttttttttttttttttttgccaaggacagcgaagtttcatttatttgtgcaaatacaggcatgagcaagaatgttctaaacaatgtaacgatttccagcattgattacagaatttcctctgatcatttgatttggttatagatgaatttaaacttcaatttaagcttgacttttaaaactccccctctgcttcctgatgaaccagcataattcctaaaattacacctaaacaagtctgtcttgacacattggggtttgcctttagaaacatttagaatctagtatgggcaaggcggctggaacgaggtttgggatgggcacaatgatttatgcttaagttctgttttggaccactggataccaaaatcattggtccatttccatttttaaggggtttccataaattggtagccaattaatcctcnggaaacantttttgnt

SEQ ID NO: 3573 - DNA, 428 bp, Homo sapiens
  Genbank Accession No. W70115
  unsure (1)..(428): n = a or c or g or t
gacctttatcaataggacttattttaatgattaccattacagaaaggaggttggttaatccccaaagattccttatctgtgaaatgaggaaggttacaataagaatgtgaatagagtactaacaccaaggaagtgaaaatactaacctcaaactcccatgtaagcatttgggggatacgtgtagtgataagtacaaaatacacagtttaataagagccacccaaatagcaatctttatattcattccttatctcctttgcacatgaaactccttgttggttttaatcacctctacaattaatagctgaagaccctattngactactctttactatggatccaatttaattaggaagaaaaaaaaaggcagctttaaggggacaaatttatggacttaaaaatgggttattttaatggaagggcattag

SEQ ID NO: 3574 - DNA, 128 bp, Homo sapiens
  Genbank Accession No. W70131
gttttttgacttcatttattatataaggaacctaactcaaattggcttaagcaattaataaatgtttattgttacattgttgtaatgtggctggaaatccagaagtcatacaaatctgtcaggattgg

SEQ ID NO: 3575 - DNA, 144 bp, Homo sapiens
  Genbank Accession No. W70313
gcatgtgcaaaacaccagacacatacagaaacaattaggattctatgagggcagagaatttgtttctctaaatggggctgttcaatgtttcacagagcacaaggacaagaaattcaatatttttgagcagaaggaagaactcat

SEQ ID NO: 3576 - DNA, 141 bp, Homo sapiens
  Genbank Accession No. W70336
cttaataaaaaaaaataatttattgtcaacaaaggtgatatatacaacaggaaaacagatgtaaatgagaacgggagtgaatggggtgcccaggcccagctttcaggcctctgcaggggtgggacaggaagaggtaatgga

SEQ ID NO: 3577 - DNA, 490 bp, Homo sapiens
  Genbank Accession No. W72044
  unsure (1)..(490): n = a or c or g or t
gactagaaacaccacacgtttaatgcagtgccatatgcactctcctttttacaaggcaatcacagattgaaattccatagggctgtggcaaaaaacagtcatctctattctgtagtaacaaacaaacaattttggctcactaagattgaaatacatggcagacaggtattcattcttagatgactatggatttcgaaataaacttcataaactgaggtgaaaattccaatatatcgcagtgtgggaaccaagacttttcattgccttttgctcagtaagattgtctacacaaactgccacgggaggaatgacaagcagttgacccactggtggatacacacaccgtgtgaccatgtaaacacgccactgcaggacggacgagcgtgaccgtgaagcgtggccacncgcgaccccacttagagtgtgacctctctataatcactgctgcttttcctggttttggtttttttttttaaacacagccctattt

SEQ ID NO: 3578 - DNA, 212 bp, Homo sapiens
  Genbank Accession No. W72079
  unsure (1)..(212): n = a or c or g or t
tccttttaatatgaggaggtctggtgtgaagacagatcaagcatgggtacctggcttgaacattgtccattaagaaaatgtatcagtctccgcatagcatcagtcaagggtcaaggaaaatgcccctgacttgcntgtgttctcagagtgtcttcgcagcacagtttntgaaattcaaatagtngttttgagacaaaaatnccgccaggtac

SEQ ID NO: 3579 - DNA, 378 bp, Homo sapiens
  Genbank Accession No. W72187
  unsure (1)..(378): n = a or c or g or t
tagttagaataagtatttaatcgtttactaggtgatctaaatcagtgattttcaaatagtaagggaggggcatgatgtatngtaattttacatttggaaaagaaaaagggaaaaanaaaaaaaaccttaccagttgagaaaccctggtctaaagataaagcttatgtnggnaataatcaagaaagggagatatttgagaagggaaagggaaatacatcacctcatcgaagtctcctctcacaatatgaacatcaccagccagagtcttgagatagtcataactctctttggtgcaaaggtttcctgtgcagagaatgtgctgaatttttcctgggcaccaggagttttttgaatttagctggcaaactgttgcaccgg

SEQ ID NO: 3580 - DNA, 450 bp, Homo sapiens
  Genbank Accession No. W72276
tttttttttttttttttttttttttgaaagtgacaaattaatatattttattgcataattctgatgggaaaaacatagctaaaatagtgcctttggtatcttatttacagtcttctagtccgtcatctccctccttcattttatatcaagtttcaaaattggtttcatggtaataaaatcaaagttgtagacctctgccatgccctgatgtagagttttgttgaaacggtcccagcgaaaaacagggaggccaccttgtactgtgggaccacttatggcataggatgtgtactgagatgctaggtagatatctgccacctttgtgtcataacaacctccaggacttgggttaggtgagttcaggtcctcacggcagcagatggtattacaggggtcacctctactgtaaggatccttcttataattgttgtatcgcatgatatatttcat

SEQ ID NO: 3581 - DNA, 577 bp, Homo sapiens
  Genbank Accession No. W72382
taagagaaagaaaaatcaaatatttattaaaagtaccataatacagacccatttcaagtaaggacaaacacaccaacatatttcttagtagtttcctcacaatagattattaaagcatagaacaattattcatattcataaagaaatgacttcaaaataggttaaattgttttccatctactctgtttaataaggcaagaacaaatgattcactttagacaaatagtctcatcaaaaaagggctaaaatagtaaagattcatcacctaaagtggtaagctttggatatctgaaatataaacatgttagtactctgatgatcgccagataaatgaatttaggcaagaaaacacattgttacaaaaagcctgggttctaaatcaggattactgagacactaacaatttcagatttttgccttcattccaagaagcaccaacccagttttctttagactggcctgggctgggtttggggccaagatctagtccaaatggtagtctgccagtggatgtaggtaaataagatagagggatgaagaaaaatttagcatcccgccagctgaatatcgggttcgc

SEQ ID NO: 3582 - DNA, 467 bp, Homo sapiens
  Genbank Accession No. W72471
  unsure (1)..(467): n = a or c or g or t
tttttttcttaagacaatgatttttattacctttagtctaccacatttgtcactataaatatacttattgaaaaaaaaccatactatttaaataagaattcagttcatgaaagtttacaaaatacaaccaatgtactctgacttgtggttatatcttaactatctcaactgtacttttctggtatggccagaccttttgcaaatattaccatggtattttaattttatgatataaaacagtagcaatttattaagttttccattataaaaattaatatggtaattctcaaaatactgaaaaaactgttttatcgaaagcagtacccacatcactgcaacgtatttcctttctcttagaaaacatcttccaaaaggcacattttaattacnagtggtttatatcnaaaggatagtagtttggaggttttggaatttccaggncaattttcccnttatccncaaaattg

SEQ ID NO: 3583 - DNA, 259 bp, Homo sapiens
  Genbank Accession No. W72861
  unsure (1)..(259): n = a or c or g or t
gaaacagttctctttacccgtgatcactgagtgacgcctggggggcgaggccgaccgagagtctggggcgagggctcccccaccgtccccctgcccccacgccacgtcgcccagcggcatcgtggaaagaggattctcccatgcaaaccccggagccagaggagaaggggaagcgccattctgcgccccctacccccggggcacggacacggccacagcacggggggcggtgaggcccggggacacgagacacgnggga

SEQ ID NO: 3584 - DNA, 449 bp, Homo sapiens
  Genbank Accession No. W72972
  unsure (1)..(449): n = a or c or g or t
tttttttttttttcaaaaaagtaggcaagtactttgctttattgacatcaaatggaacttcttgtccctcacgcagtccacacaacagtaaaggcacaatgaggcatattaaaacatagccagtttcaacagcttggatatttcctgccatggaaaagtatcctgcccacagattcacattaacatacatggtacattaatatcaatctctatcatataccaggccacggtacatgtttgcacgcagggtcacgttctgcaacaaacttattctaataacagtattcagaaggcaccctatgggacacaggtgacagttgaagttacgaggctagatgggccacatcttttacatccaagaaccgccctggggncacaccccaaactggctngaggtgcggaggcnggttctgcaaagcagggtcagaaacactccccccataccccaa

SEQ ID NO: 3585 - DNA, 359 bp, Homo sapiens
  Genbank Accession No. W73038
ttttttttttttttttaaaaatcagatggggactttattgtgatggtggcaggtccaccagcagatgcaaatgtggggtgctgagagtggcaacacaggccaccccaaaccaacttcactccctcccctgtcctcagccagtacagaagccaaatgtagccccagccctagactccagcccaggcagagtccaagggaggggtgtcagggtcagaagtcacagggagcccagtgactatcaaggtggctgagagcaaggctagggtagggatggggcagagaaagggcagggggtgcagcccaggtggcccaaagcaacacagaggagcaagggctggcattcaagtcagcaggtccct

SEQ ID NO: 3586 - DNA, 498 bp, Homo sapiens
  Genbank Accession No. W73189
tttttttttttttttaaaatctcgcccttggtgtattgcctaagtcagtaagcagaaagcaccttcttcctggagaaggatcaagtcctcaaaaggtaggaaatgtcaaagtgtcacttcattgtcattaaaaaaaaccaaaaaacaaaaaacaacccaacaaacaaaccccctaaaccaaaaccaccctgtgaccaaaatacccccgagtccaggaattgctgtaaacaaacccagatgcaggatcaacccttctcagcggcagtcggagctgacggcagtcactgcagtatcagtcctcgaggcaggggctggcgggagtgggcaccaggagggccaggctgccaggctgtgcgcgtgatatgtacctggagctgcagacctgggggttgcccatcctcaggaaggctgacctttctggggtccccgcgttctccctgacccaggaggacaaaagccctttcagccctgtgagccaacaggagaaaccctcgtgcc

SEQ ID NO: 3587 - DNA, 445 bp, Homo sapiens
  Genbank Accession No. W73194
gaacgttaatatttttatttcttttgtaatgaagagtacaaatggttgggagcaggacatcacaggaggaggaaagatagcgccatctctgcagaagaactcctgagccacacacagaaggaaagttgatccccagggcagcctttcccaccaaaaaaatcaggcccaatccaggagagtttgccagtagctccccagggttccagggtgtctgccagccttcctaggaatcgtgggcaggcttctaggtgccagtgactcaaactccttttcccacttcccagttcaacctggtcactctcatccccacaagttcccaatctgaatcccattctctgaccattctctgcttccttgtttttaatctcatttgagagtgatcctcacgggttcccctggcccctgcactcattttccttactgggtatgctaacgttcctcgtgc

SEQ ID NO: 3588 - DNA, 416 bp, Homo sapiens
  Genbank Accession No. W73382
atatataaagtatttatttttaatgcacatatttacctacaaaatttacagaaaataaaacaaagcagaatatatagaataccctcttaagacttcttaggagctgagggttttattgctgcagttcaaagaatcaaattttatacaagtgaaagctaagatgaacacatttaagttaaatggcagccttgttaaaaagcttttttatcctgttattgaattttcagctttatgttaaatgaaatttaaaagattgctcatgaaataatttaaaccttttcaaaatctaataaacaggtaaaaggcacctccagtactttaaaatatttacagcaatcccaatagtttaattttaagggctattatagtacatgcggctattatgcatacacagtatggtcattaacactctctaa

SEQ ID NO: 3589 - DNA, 425 bp, Homo sapiens
  Genbank Accession No. W73601
aatatgccacaatttttattgcaacgtggccatttttgtgagggtggggagtttgatctcaaaacaatgttccatttaaggctcttttatacagaaattgccatcatgactgatattcaaaatatctttagtgttgcaggactcacatggtaaacataaaactcctacacttattcagtagtgtacactcaatggaaaacaaaaaggcattaataacagctatttcttttaagaagatatgcaggtaacaggaatgaacactgaggtactaggataagttgatgacacagttaacaaaacttaattggcattccttttaggatattaaacttattacaaaaagtgcttttaatgcatagtgttatatccgtgctgccatatcactaaaataggcttgccaaggcagggtgaggtgtatgaatgcg

SEQ ID NO: 3590 - DNA, 490 bp, Homo sapiens
  Genbank Accession No. W73818
  unsure (1)..(490): n = a or c or g or t
ctgtttagccatcccactgtaatgctgcactaagccttgagaacaaagagaatcacgcaactgggaaaccaaggctttgtgattttcagccaagccaaacatggtcactctgtcaggaaagccttggactcatccctgactgactggctgtttcagtgagttctttcttggcttaaaaaaaagagtgagaagaagagcagttgtgtggtttgcctgtggggacttgggcaatgggggtttgtagagccaagtggccaccatgataagcgagactgacttccctgtgccccgacatttgggaggaggcagcacccccagcacacgcctgaggttcaccagcccctggnccttggcacagattcctcccttctttgcctggaacaactgtttctgttccccaccccattgtgtcctccaggattcaccgtagagatcaccattttgataagctaatctgcagcggtgaagccttcaccaagtccctcgtgcc

SEQ ID NO: 3591 - DNA, 566 bp, Homo sapiens
  Genbank Accession No. W73889
  unsure (1)..(566): n = a or c or g or t
tcctctccgcgaactngcaccaactttatttgcaaaaagaggctccaagcgcacggagaggatgggggctgcaaggtccccaccctcctcccggcctcccgcggctcctgccctcctccaggccccccacggcccccgccccgcnagctacacgatcccgaactnggcacnctntanggcagctgatcgcggcagctntgctcgaaccacttgccgttggcgcgcctgacaggaccgcgcagttctcggtcttgccgccatcgggttgcgcggtgatctcagtctcccagttcttgtaggcgatgcgggcgccggtcatgtccacccaggtgccctcggncgccatgtcgttgaggcccagccagatctcggcctcgttgcccacgctctggcgcaggtactcatacagggcgtcgttctccgagccagtctgaggggtgctcagggtgccccgcgcgagatgcagttctcgctgggctcgtggaangtcttcgtctgggtgaaggcagaaagcattttatgtgnactttgggtcccnttnagggaanacgtttgaagggctgctg

SEQ ID NO: 3592 - DNA, 425 bp, Homo sapiens
  Genbank Accession No. W73914
cttattaatatgtttattgagattataaaatataataagttatatatatacagaattagacaaaaataatattgacaattaagacttcactgtctaagggccacagacctaccctggggtgttttctaaatgttttaaagtattgcagaattatgaatatctccacacaaaaatggcaggatggagtcccagctttggtcagtgagaattattatgatctcattgttctgaatcccataacataggctaaagcttgtcagagtaaatcccatgtttccaaataagtaaatgacaagggaatttgtaactatataaggaatagctccctaaaaatggcaggtggagagccaatggaacatgagctgacactggctggccttacagccccagaattctaatagtgtgaaatgaggccaaagcaccag

SEQ ID NO: 3593 - DNA, 415 bp, Homo sapiens
  Genbank Accession No. W74158
tttttttttttttttttttgaatttttaaaaccttatttaataaaaggtttaaagatacagaagaacattcaaaagtaaataagttacataggtacattacaatcacatcagcaagattctttagtgtattaatttttttcttataaaaagcacacaaaaaataaaatcttcagtctctatcacaactgtacagcaaaacgaggtaatatttatatatgtacactattttaatactgtaacacgtctttttaaaaaaggatgccacaggagcaaacacacaaaaggcagtgtctgatcatttttgtttcaaaataaaaggaatatacttatttatatgctattaaaatatctgtacaataattacagactgtcaaggctgttcctgtgctctggtcccctccaacaaagccttca

SEQ ID NO: 3594 - DNA, 429 bp, Homo sapiens
  Genbank Accession No. W74233
  unsure (1)..(429): n = a or c or g or t
ttgacgttggcagtgacatttatttttctnnggggaggggagttatatacagcagtgacccggagcccctcacccccaccaggcttaggtggggacaggaggcgttggcagaaggcacacagtggcagtagccagaagaggccaggaagtaagggtgggtatgtgatgtgtcctgggagacccagatgaggaaattgaggctcagtgagggcctcaggtcacacagtaaggtgcgaaggagctagtcccgagagcttgtggtggttgcttctctcttgcctgggctacaggaggacgcaggggcagcccccgcccttcttcctgggggcactgggagggctcggtgggagctcttgttcctggtatttccggacagcccgcaccagctgcttcaaaagcctcgtccacgttgagacgcattttggccga

SEQ ID NO: 3595 - DNA, 610 bp, Homo sapiens
  Genbank Accession No. W74536
  unsure (1)..(610): n = a or c or g or t
ttttttaagatgtgtcaggtgtttaatcatcattgtggggggctctggttgtagaagaaagcttggcaaggtggggttatacaggagagagattatacaggagagagttggtctgaggccagaacagttcaagggaaaaagaaaagggagctgatggatgggatctgtctgtgggcccctcaaggcctccagtactactctcgcctgcctcaggttcctccgactgattcagttctgcacgctcctcctcttcctcctggttttctggggccttcctctcctctcctcggcgttgcncctttgccacaagatgaccccaatgagcagggcggctgtccccaggcctcccaggatccccagggccagggctagagttcccagccctgatcctcccacagagcctgcagttggcccctcctcgcctggttcgatgatgctgatgctgacagcacggctttcctggggcccgtgntggaatgggtggccacacagctgtaggttccctggtcctgaggcctattcagggaggattagacagggtggggggnagggaagggacctcgtgcgaattttggctcgaggcaaattcctatagtggtcgataattgga

SEQ ID NO: 3596 - DNA, 428 bp, Homo sapiens
  Genbank Accession No. W76097
  unsure (1)..(419): n = a or c or g or t
gtgggagcacacagaccaggtcccaatcctggttctgcccctgactggctggtgactctgagcaagttgcttgacctctccaagcctccgtttcctcatgtgcaaagtgtggacaaaacagtaccttcctcataaggaacgtgcgacgcgcctcagaagtacgtgttcataaatggtagccattgttgttaccttcccgtctgtgaacatggatcacatcatctctgtgggtaacccagtcctcgttgtatgacttgtcaaaatgcagttccacttgtattaatattgaccctgttcatcgtcaccanggactgcatcttgcaccactgtgccgtcttctaggcacacacgaccccgttatctcccttggaaaaattcctctcactggaaatgtacaattaaaggatgattgaaatgtttaaaaaaaa

SEQ ID NO: 3597 - DNA, 437 bp, Homo sapiens
  Genbank Accession No. W78057
tttttttttttaaagatatgtcgttcatttattctgaatcttatattgatagataataccagaagatttcagcatagcagataaaatacagcaaatcctaaccagcacaggttttagtgacaaacgggcccgttccatggacatagatgacttcatcaggtaattacatttttgttttcctaagtgtttacatttctttactgtgacaccttcagattggagattttaaaggcttttaagcggtataaggtgctacctgggagagttattgcatagcacttccatggcatggaatagtatttggtgtagaagatggaggctagttagctgcagcagaatgaacattttctttaagaacagtagtaaagaacagtccgagccagaagattgcctttgtgttaatgtggtgtgcaggttccaatgtggtgtgcaggttc

SEQ ID NO: 3598 - DNA, 437 bp, Homo sapiens
  Genbank Accession No. W78093
tttctttgttaggctgttttaaacgtcttagcaggatgtggacccaggtggctaacggccaatttggcgacgcaaattcttctcaccacagtgggttcagagaatgaggagagggctgggaggtgggctcagggactctgcatgttgctgaagggtgaaagagctggaatgctggctcatctggccccatcaactcccaaccaaatttgtgtgtccttaggcaaagccaccccctgtctgaagctcagttttcctgtctgtaaaatggagaaaccagacactgtccacacaaggtgaaggggcatccaagaatgtgggaggatttaacagcattgtagctgtgggctgcactttgggaaagttcaaagggctcctcgaatgccagggaagtctagaatagtgacgggttccggctgcccaagtttgttctccaacct

SEQ ID NO: 3599 - DNA, 420 bp, Homo sapiens
  Genbank Accession No. W79046
  unsure (1)..(420): n = a or c or g or t
atgcatctgacagggcaacatttcatacaccatttagtcacctaggccaaagtccggaagatngctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgtcttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcaga

SEQ ID NO: 3600 - DNA, 432 bp, Homo sapiens
  Genbank Accession No. W79421
tttttttttcaaattaacaaactgtaattgttttcccaaagatacatttttttcatacacatccatcatacactgtaaccaaaaaaagcagtgtacatgaaataagagaaaataaattaaaaatccatagcataggtaaggaggctctagtctggagcacagctgagtttccagcaatataaggaggctcgaaagtttcttttataagaatgcctgctagcaagggttccagcaaggtggttggttggtctgtaagtcagtcttgagtacttgaaacagttctgtgtttgttttttttccttagcgtttagaatagccatcattgtcctgcaataggcagagctatcacgtccaggaaaaatgagggagggaaccacagaggcagcgtgagatccaaatacagcattcaaaggtaattggtccagtggtgcc

SEQ ID NO: 3601 - DNA, 463 bp, Homo sapiens
  Genbank Accession No. W79422
  unsure (1)..(463): n = a or c or g or t
tgcggcagtgcaggcctcagagcacaatggctttatttgtcactgagtggcggaccaggcctacagccgagggaggaccccagtcacaggttgaaacaaaggcttgagcctttgtttccagaagagcagagaaaatctcatgatcggcaggagagcaggcagcacttttccagcacactggccaaagccgatgcggtaaccatccccctggcagtaccctgttatgatgacttcatccccgtccagcagaaacttcctggtctgaccattccccaggtctatgggcttcgttcccttccacgacagttccaacatggagccgaagttttctgggctccggcccactgatggtcccagaagccaggaggtcccccggccgcagtttgcagccgttgacagagtggtgagtgagctgctgnagnatcgtccagtacatgtacttaaaattggactttgcatatgg

SEQ ID NO: 3602 - DNA, 425 bp, Homo sapiens
  Genbank Accession No. W79773
gaagaaaacgtacaaaattatatatatatttatatatataataacatgacatatctatgtacaacatggctgggacagttgaagaaactatacaatggtgttcagcattttccccttcccagatggactttaaggatgacagcatgaggaaatggagcaagaaacacaaaaattatatacaattacaagtgacagtcaaggagtttggggaccagggagtccagggatcctgctctctccattccttcctcaccaactttctcctatccaatttgaatgacagcctgaacactgaatggccagtcaggagaaaggcatatacacacctcatccccccacatgcacatcagcaagtctatcagtcattctcattgggccaaatgtttggcatatcagaatttgtgatgtgagagggcaagaggatt

SEQ ID NO: 3603 - DNA, 400 bp, Homo sapiens
  Genbank Accession No. W80609
aattcttgtggcaaatttaatagaagaatatgagactcacccttacttcccacacataaaacactgcaggcactccaaatccttacagacatatgcacttcggaatcaactcaggcatgcacagcatccctgtgctggagtttattttaaaaaacaacgccccagttatcacagtttctttttttgttcaccattttccataacaaaagaagctacacaaaatttggggggagatactctctttggagactgacacatttgcagaggggtcatgaataatgattccaaagctcctatttaacttctgaatcaggcaaagaataagtgacaatataagaatgaattttgtttacagcaatatcataatacagcattgaatcattacagtgcagtggttgta

SEQ ID NO: 3604 - DNA, 186 bp, Homo sapiens
  Genbank Accession No. W80730
  unsure (1)..(186): n = a or c or g or t
caaatgtatcagtttattaaaaatgcagcatttttcacatgagctttaaagatgtggaagatggggtacaattaaaaccatgagagttgtgcagggaacagccgtaggncntgtttgcaccttcagatattgcctgctcccaaaaattcagacccccagatgcagggcaagacaataagaaagggt

SEQ ID NO: 3605 - DNA, 276 bp, Homo sapiens
  Genbank Accession No. W80763
attggtttaatcttttatttggaacaaaggaaaaaaggactgacaccagtttagcctttgagtgtgcagagctctgccctccctcccacccctcagccccaaatccaagatttcatagccctaacacccacccaagcagcttccctcacacatgccctttgttttcttcctctcttctatggttccttagggaaaggagccttctttagggatgaaaagctaactacagcccagtctggcctccagcagcccagggtcagctcagcctccactgga

SEQ ID NO: 3606 - DNA, 544 bp, Homo sapiens
  Genbank Accession No. W80852
  unsure (1)..(544): n = a or c or g or t
gacaataaggtgtgagcttttattgcttaattctctgaataattcaacgtagacgtcttaaaacagtttttgtttcaagacaaagatgggggatattggattgactgattactttcgcacctaaaactgaaaggaaaaaacttaatacaagaattggaattgaaaaccctagcaggatacctagtaggtaagggtttggatatatctgtatctgctcataagtaaaacagtgattgtgcaaatggtactcgcctaagtaccattaggttattggtattaaggtactaagtacaaggcaggtatcagccactggtttgaaaanattcaaaccagtcaaaagatgagtcanagaactcctccagccaaacctgggtaaatttggtttgcttctggcctgaaggcagtgtgaagtgaaattagtttcacacttaaaacnagctgacacctttntaatctggancaccnaaatttgggncatctaccngggaaagtggggaaattccccagggacggncccccaatattttaacccgggcccttaggt

SEQ ID NO: 3607 - DNA, 627 bp, Homo sapiens
  Genbank Accession No. W81053
  unsure (1)..(627): n = a or c or g or t
ctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactacggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatgggaagattagaggtttgtcaacacaaagacacaggaagaatgggctgcagaagatttagatgntttccatttgggcacattttacttagcctggngactaggtttaaacagcctgggagggaatttgaag

SEQ ID NO: 3608 - DNA, 470 bp, Homo sapiens
  Genbank Accession No. W81079
tggaaatcagaggtgaatatttatttaattcatatataaattttacataatattcatggtgctataaatataggcacattttttaaaagtccagatacatccaaaaattaccccctcactgtagcctactccaatcccctcaagacggaatatctaacagtgtttggaaaacagggtccagaaaggccctgcccattaattttaaaactttctgaccatcaagaccattctttcctgcttcaaccaagcagagtcaacaaggatcatgtgttttcagggttttaattgcactagttgatgaattaagtaaatgcctctgcctgggtagtttgtaataggtttatgggtttggtttctcctacttagttcaagtcagagaaagaaaaaccaatatctatattcctattggccttctttaaatccctatgagatggcttaaaaggatgtcactgcaccagaggactcacttg

SEQ ID NO: 3609 - DNA, 605 bp, Homo sapiens
  Genbank Accession No. W81268
  unsure (1)..(605): n = a or c or g or t
cgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaattgaggattattaagctaaaacctgggaaataggaggcttaaaattgactgccaggctgggtgcggtggctcacacctgtaatcccagcactttgggaggccaaggtgagcaagtcacttgaggtcgggagttcgagaccagcctgagcaacatggcgaaaccccgtctctactaanaatacaaaatcnccgggtgtggtggcaggcacctgtagtctcagcctcccaagtagtttgggattacagatgtttggagcccctaagccagtttgcaccagctctcagggtcctcacctgggtatg

SEQ ID NO: 3610 - DNA, 376 bp, Homo sapiens
  Genbank Accession No. W81375
  unsure (1)..(376): n = a or c or g or t
cattcatccaacaaatatttattggataccaagtatgtgcttggcntggtaccaggccttagggacacagaagaagaagtatacagcagtgtaaactgacatttcttaaccactatataaataaaccccactttactactaatcgtgacatttcaacatgttatacctgataagacatgtaaagagggcacgattttgaggtatatagcttctttttctctacaattaccatgtgatataaattcctaaaccccttcaaatagctttataaatgaagagcttccactaatgaaaacctcccaaaattacagttcagttttagggagacaaaggaaatggaacttcgggtataaaaaacaaaaatgaaactgggggt

SEQ ID NO: 3611 - DNA, 390 bp, Homo sapiens
  Genbank Accession No. W81540
gcaaaataagcgtgttataaaatttatttgtgtaagcattcagacatttttaggtgggaaagatgatatgcagaatccactacaaggtgcaacagaaaatcgtattggaaaggacggtacatctggcgcagaccagcagtggcacgattccaaacaaatgtcagacgagagcgcttcatggggagaaactgaaaattataatttaaagcttcatgaggcaagatatgttccaatttaaaacactaagaaatagtaccatcgatgaaaaaggaaatcaacctccaggtgtaccaaaaggggcgtagggcaaacggggaaaatttgcatttgttgaggtacaaataaggagtgttctgtaagagaggggcattaattattaatgacaaaccc

SEQ ID NO: 3612 - DNA, 408 bp, Homo sapiens
  Genbank Accession No. W81552
taatctcaaaggcaattgagtgggtcttctgggccagacctatttaatttacgaaacatagtaccttgcagagaataggcattgaaatattatttaaacaatcaaaccaaagatgttcttctatcttcagctgtcagtgatctaatgccctcatctctcttatcctcaggacccagaatggtatattccacataaaagatgctttgtttatcaaatgaatcaaaaagcacgcctgaggatttatttttactcctttacttctgtaggccaggtcaaggtgggtctaattcacttttatcatcagcacttaagaaactggatggaagaccacaacaccttgttttttgcaaaaattttccatctcctcaatcaggccaggaagcatgtatcttctggacaggactttat

SEQ ID NO: 3613 - DNA, 370 bp, Homo sapiens
  Genbank Accession No. W81654
tttttttttttttttttctgaaatgatctgtctttattatgtcatcagaaaacaaaaaaatcccccgagtgtaaacaggagaaatgtgctggttaagttactcatcattatcttattattaacaaaataaagcactatctatgtttacagtcataaaaaaagaaacagcctggagagaagtgggggctttgaggatggagagaagacgggggcagacacagactccacatctggccctgtggaatttggggttcccgtactgatccaagggctatttagatcttcagagttaggtgacaatgggatttgatttccttagggaacaaactttgttgaaactgatcagaggctgagatccagtccctagtat

SEQ ID NO: 3614 - DNA, 399 bp, Homo sapiens
  Genbank Accession No. W84447
ttagctttgatacatgcatatatttaataatgaaacaattcatcaacagcaaaaagaaagtagaaaaattcgtaagacctcagggctgtggaagagaatgggacatcaaggaaaaaagatatatatagcaaccaacccagaaggctgcatgatgagtgaagcaaaggcaagtttggctaagatagtattatatgctctgaaaagagaatggctggataggtacccacttatgtgactgcttactagcaggcagccttactgtatgcctcatggaatggaggcaaaaagccagggaaaggtgggaggggagaaggaagagaactgtataaaacccagggtaaacaaatgagtggggcagaattacagagagaggactctaaagtccttttgtttccttga

SEQ ID NO: 3615 - DNA, 421 bp, Homo sapiens
  Genbank Accession No. W85765
ttttaatgtaaaaatcaatttattatacaacaatcatagataatgctttttatctacaaagaaaaatggcttctgcagcctccctgtctactccattcatgatactatgttcttaagatataattactttcaaaggaaaacaaagcgatatccatattttccaaacaaggaagcccccagacacatttatgaacgatatggaaatattggaaagaactcaaatggactcctagatacaaaaggctgttctgcccatcacagtaaacactgttttgccttaaaataaaaataataaaatatttctcaaatgcaggggtgaggactttaccccgtaacatgcctaagtggttcgatatataattttgatggcttgacaattgctatgtttaattcccattcagttaacattcccattttggta

SEQ ID NO: 3616 - DNA, 443 bp, Homo sapiens
  Genbank Accession No. W85847
  unsure (1)..(443): n = a or c or g or t
cataattgtacagacacaaaattgtgtctcactgtactcacgtcgatttttttagctacatttgggcattacggtactaacaatatcagaaacaatattttgagtatcttacatagatgaaaactttcatatttttcatttaagtttngattcattactatgggttagatgccgtcgggctnaggtgctggagctctcttgttctcaatctctccttttgtccttattcaccacaatgttaatttggagctgagagattcatcactgaccgcatctattacctttctgcttcaccttggctcgctttggcaacttcgcctttggacttctagcatgacagacatagctgcgcttggagatcctcagaggtaactttcttgatggctcaaaatcngagttcttgtttcatcttctgttctactatgacttatactttcgttaan

SEQ ID NO: 3617 - DNA, 439 bp, Homo sapiens
  Genbank Accession No. W85875
  unsure (1)..(439): n = a or c or g or t
taggaccacatttattaataatatacgttatgagaacaatcatttgcagtctcactgtgaaggcaaaaaaaaaaaacaaaaaccaaaacccaaaggataaacagaaatagcacagtccaccgaatacactgcatggtgtttataactgtataaccaaactaagtaatctttcccctctctttaacttttatgcaccacctgccattctagatactatcaatcacactaaataataataaaaaccaaccaccttcaatctgatcattctgggcaggaaactggaatacagttttgaccagatcttcgngaaagattcatatacacgaaattaactnagttctgttaaaaggctgctataaaaataccatcattacgngctatacagaactttagaatacagctaagagtgccgaaatactgaatttccttaattgagggg

SEQ ID NO: 3618 - DNA, 444 bp, Homo sapiens
  Genbank Accession No. W85886
  unsure (1)..(444): n = a or c or g or t
cttgactttccaagccagactgcctgagtatcacttaaacctagagtgactgtacaatttatcatccaaagtaggacacttcttagcatgaaaagggcactaaacataattaacgtaagtataatccaggcccgtctgagcaaaccaagatttatgtccttctttcagctcgttcctgcctatcacctagagggcttgacttctctctgctcctcttggcattcatactcagcaaagccgatggatatttcagttcaatcttcaggctcttttgcagtgagtgcctctggagcatgtgacctaactgagcagacttttgtgccgcctactgtgtgctgtgcagccctcctcagatcccattccgtctccctcttcctacaccacttccttgaacctacactanttgcacttttcagctgttcaatttttgtctgtcctggactc

SEQ ID NO: 3619 - DNA, 439 bp, Homo sapiens
  Genbank Accession No. W85888
  unsure (1)..(439): n = a or c or g or t
ttttatcttttggctttcaggtggaattttagaaaatacctggcaagtgaatagttctgaaagtgcttcctcttaagttctttggtataatttggtcattttgatagtaatcaacccattaagtaggtactttaacaccctcatatcaattaaaatggaatgtggagtacagatatttagaaaaccatgactgaggaataaattatatttttgacctcatggaaaacagaactctaaaattttacttatgtttctgtggcaaagatagccatactgcctatgaagacatctctaactttatattaaagaaatgttctataaaacatctctttctgattattagaagtaactgttctatatacttttttaaagtagaagaggcaagtttcaacttgaaaaaagaataattttgaatttcataaattatacnccttcntgc

SEQ ID NO: 3620 - DNA, 430 bp, Homo sapiens
  Genbank Accession No. W85890
ttttaatacaccattgtcaatctaatattttttggaaaggtgcttttatgttatgtatttgaaatatatatacacacatacatatatgtatacatatatatatatacatttttgggtttttttgtttgtttgttttgttttttgagacagggtctttgttgcccaggctggaatgcagtggtgtgatctctgctcactgcagcctggagctcccaggctcaagccatcgcctcagtcccacaaatagctgaggaggagaatggcttgaacccaggaggtggaggttgcagtgagccgagattgcaccactgtactcgagcctgggcaacagagcaagactccatctaaaaaaaaaaaaaaagataagaaatgatgaggtgcttgagtttgtgtgctggatgaaataaggcacactgccattaacatgttt

SEQ ID NO: 3621 - DNA, 395 bp, Homo sapiens
  Genbank Accession No. W86075
gatttgaagggattgctttatttaacgtgaaaagcgtgatagaggaactgtttaagataaacaacttataaatactcccaattgtagaagtgaaagattgattctatgaaaatctacaagtgattaaatttagacatcgaatatcaaagactttatagagtcatagcatcttatcaaagatcatttagcagaagttatgcttagtctgtaggttagaagcaatgattagtgagacagattggtttgtgggatgactcaggataggatgattatcagtaaaaaccttcccaggtaaaaattacaagaaaaagaataagaggatagttgcaaaagattttatgggaatttagtttaaccactaagcataaaatagtactgctctgggttgtgaaaaa

SEQ ID NO: 3622 - DNA, 417 bp, Homo sapiens
  Genbank Accession No. W86214
caaatccatttggaacacatttattcttgggatagtttggacaatcacaaggcaattctaaggaagactcccacgacactgcctaagaccaagatttgggaaaattgattccactgatcactgaaaaatttcttgcccagtaactcgtcggtggactttatccaagaactgggggttcaattagtaggccaaactccacacctcttacagtaagatacataaaagataaattaggtcccctaggcgcaaggtcaggtgacacttcggtgactgcagaaggggcgattcctagagatatgcttcaaagcaagtgggacttagagataagcagagccgagaggtgggatacggctgctcgagagggatctacccacaagataagccacctcccgccagcccccaaggtttgctattcga

SEQ ID NO: 3623 - DNA, 381 bp, Homo sapiens
  Genbank Accession No. W86375
ggttgaaaagagctttttattactaaaaaacccacaaggtgctgtcttactcatttccagttaatcatttctaaagagaaaatttacattttgtttttgttttaatgttggtcataaatttatacagttgttttttcgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattg

SEQ ID NO: 3624 - DNA, 434 bp, Homo sapiens
  Genbank Accession No. W86431
  unsure (1)..(434): n = a or c or g or t
ttgcaggtttgggcccaagggcttnacctttaaagaagatgtaattcaccatgatcacgaccgcattgctatcgaggttcttaagcaagtccacaatcttgcccttcgtttgctttgccacataatcattgatctgcttcatggcccctgcagagtccctaaagttggtggggaaagtgtctgccaggtacagcgtcttcatggcacttacgaaggtgtcctgcaggtctaccaccaggtcggtgaaaagggcattgccgacggctcaagctggaagccaatctctgggctggttgagttcctgaaggangctgctgaaagcctctgtgcagctccttctctgagcttttctggaggttgaggcccaggccctccaggatctgcatctttgtgctggaacccagcccccagggaagaagcatggccaaggctca

SEQ ID NO: 3625 - DNA, 322 bp, Homo sapiens
  Genbank Accession No. W86600
ttatacttaataattttattacatgtacacacaaaatcatagcaaaatatgatatattttataggatttttttgtcttttcatgatgccatcgaatatttgcaaatgcctaaatggaaccctttcttcattctccacacaagtccaaaaacacaaacacacacgcacacacatacacctatacacatgcatccttttaaccaaaggtaatactcactggtgttaaaactaacagctctactggacaatggcttcatggacattttagaggcagtcttaagtctgctgtgggcacaggcatgtcggatatgatttccctgcag

SEQ ID NO: 3626 - DNA, 380 bp, Homo sapiens
  Genbank Accession No. W86748
ctcaaccaaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagccagtctcagattcttcattgcttggggaaacatgccttgatgtagctgcagtttggccaacttt

SEQ ID NO: 3627 - DNA, 458 bp, Homo sapiens
  Genbank Accession No. W86756
acctttccagatgctttagacattttctcttatctttactctctttatggatctgtcatcctctctaaagtattagctatgcgtcccagctaaggcattgctaaggattgggaacggctaaagctgtctgctccaaagcatcttaaaatagatgcatctcctgccttgagatattcattcgaacccggatttcaccaaaggagggtccttatgtacttgcttacacgaagcaaatttataggaaaacaggggaaacgtcttgattaaaaataaacacaaaacactggtaaccgctccgcctttcctgggtggcgctggtgtgcggctctctccacacgcgtctctctgtacagcacatacatgtttacaccacacacctgcgtggacgagcaccagatcacgcaccccagctccacgacagggacaccagccgactacccacaggctgcacattccgg

SEQ ID NO: 3628 - DNA, 414 bp, Homo sapiens
  Genbank Accession No. W86850
  unsure (1)..(414): n = a or c or g or t
cgcaacaggatccggtttattctgccttgnatcgtcggtcctcgagagtggtgggtgccacctgtccnnngcggananagggcccgangcatctctaangcaatgnggganaagcagggggctgcagctcgngaatgcggtgaagccaggccgaggccggagcagctgtggtaggccanggcagggtggaaggcaccggactgggaccggnccagggctacagggccgaggacccaggccacacgggcaccccgggangcggggcacagggtcacgtgacacagaacatgaaacacaggcacagggttcacagtaagcacattggacaagtgggcacagggtcataggccagatgcacatccagccatggtgggccagacactgggacacagtggtggtgtcacacanagacca

SEQ ID NO: 3629 - DNA, 630 bp, Homo sapiens
  Genbank Accession No. W87454
  unsure (1)..(630): n = a or c or g or t
gaagcagtattatttttattatccaaggcaagaccagtaaaacacaaagccccttaaacattatttctgcagaattccaagaacacaggagaaactagtaaattgtataggattaataaagaatatggattgacagaagaacaatcataaaacattcatattggcattcttggcaggcacagctctactccatggccatgtggattatcagaggtctcgagttccactctctgacaggaatcaggctagattatggtaataaggaggcctgaaggtcttatcagcaaccccccatcgaggtgggaagatgacaaaatcagcaatggccactccagggcggacagacttagcagtcaatactgtgaaaatgggatgggtctgcatgggtcaaaggcccactgagttggataaccatggaaattcctcagggttggtacctggtaggggtggtataattccccgtgccagggccacaacattggacggggggaagacatccnggtttgggcaagccaacagcttgcccctgggtatttattaatgaccggnggtaccnccctgggacctgggggatcccccanaccagggcatngggtatccaggaatcccggggnttggcagccntgggcc

SEQ ID NO: 3630 - DNA, 385 bp, Homo sapiens
  Genbank Accession No. W87480
cggttgatttggttaattgcataaaatgggataaatactcacatacatcatctgtttaacaaaactcctaggtacatcagaatgcaaaatataaaatgcccaagagactctgatcagcaggcatatcaaattgcagtgaggcctgtgtcagcttggttccttcccacttcttcagtattcctatgaggagttctttctctcctactggagcctggacctttgacataatggaaaagaacctaagaaggcaaggcattctgataaaacgcgacttcagcctttacatgcgacattttatttttaatctaaaaggatcaacaggtcttgggtcagccttaggaagggaagcatcactcaggtaaaagtatctggaggaactttaaac

SEQ ID NO: 3631 - DNA, 388 bp, Homo sapiens
  Genbank Accession No. W87532
accaccaaaatgccagaatttattcaccaagtgagcatcgggtaacatccatggatgagagtttaaacatctcttggttgctatggagggtccaagaagaaaacaaaatccattagtataaaggtttgtatttgctgtgacctctattgtcttgagagacagagtagacagaagaaataacaaatgtgaagtcctggaatatagatgagcttgtgatgaaagacggaacagagtgaacggtcagagctgttggaggaagaaagcaggaagggcaataaaggtccaagtggtagccagagcctcggtttattctagatgagaagggagatggtggagtcttttaagcaggagagaaacatgttctgagttacattttttaaaaatgtaa

SEQ ID NO: 3632 - DNA, 335 bp, Homo sapiens
  Genbank Accession No. W87606
gactgacagattatcttattttattatttaacgtatctcatgttttcttttaaggtctctattgagataaagagttccagggaaagaaaggtcacagtgctcggtaaacaacccagcaaacggcggctctgctgctcgcgtcgggccaagctggtggtctggggctgtgacggcctctcagtgtgtgatgaagtttcagcgccctccacagtggcagtgcagcttggaatcccgcttccggttgtgttgttcattctggctagctgagtttcagttagttcatgatctgtttaaaccagagtgagtacctggagaccttggttgacaaggaccat

SEQ ID NO: 3633 - DNA, 553 bp, Homo sapiens
  Genbank Accession No. W87781
  unsure (1)..(544): n = a or c or g or t
agtttttaagaattattttaatacacttttcctgcgaaactcaattcaaggcagcttcaaggtaaaaatgcttatatttggcatctgtccttgtatttttaggcaccttgatgcattcacactcactacgctcacacccagaagacccccaagaaatccgcttctttgtgcagataaaggaaatgcaaactggtcattctggaaaccagggtcaattctagatttctanaagcctggctgtgggcctcaaggccttncantgaaagcaagggcctcagattgaccctttccaagcatcccctaccaggaggggaagggcacagattctcaagggaccgtggtgcatgcaggtaaaccgnaacctctaggctggcacgtggcaccactngccctgggagacaagccatccccgctctctggtctggatggcctggttcaatgcagtgtagatcatnggatggtgatnttctctcantgatattcggggggatacaattttaaaatgttatccaagtatcntgatgggaaataaggangggaggttacagaaaaa

SEQ ID NO: 3634 - DNA, 346 bp, Homo sapiens
  Genbank Accession No. W87824
aattaccagttgattctgatttgtgaagacctttgcagactgcagcgggcttggcaatgtctttccgctctgtctcctggaattgggtgtctgggatgacggacttcgtggagatggattctcagccttccgtttggctgccatggcaacaaccagtttttattctctggggaactattctctttgcctaccatttcagacccttctccacaaggtctcaaaggaagaggtagcgttccacagctttctgaagcatacggactgataggagacggaggctctgagatactggtaccagctccttcaattttgcttgatttggtaggacctagagagtccttactaa

SEQ ID NO: 3635 - DNA, 265 bp, Homo sapiens
  Genbank Accession No. W88568
gttttttaacattttaatttcaacgtgccagcatttgtccaaatgagatgatacaggctagaatgcacggcggaattccagactggactcactccataagccaactcatcactgcccgtgaacatgaattctggtcctcagagaagctgacattgtttccctgaacattcccgtggtctccctctgaaagccgatgaccatccaaccctgactcacctgaaatatcctacgagcatcgccctccgagactgacgattattaacca

SEQ ID NO: 3636 - DNA, 415 bp, Homo sapiens
  Genbank Accession No. W88946
  unsure (1)..(415): n = a or c or g or t
gctgattacaatttattatttcttttcatccaccatccactcctcaaattatacgccctgacctgcccaacactgtcttatgttcaggattggcatcacagaggtacacagttccactggttccagcttctgggaatcgggaacatcgttgcagtgtgtaactcattttttgcatagcttcattgctgtagtctacatgagaatagacaggaaacccaagtttgcccaatttctgggcgtgggaatagatgacatacgtcacaaggccatggagccggttattccngaacggtgcctgccattctcatctctccagtctggtccattagatcccagcacacaggggtcccctcaggccccaggagacagcaggtgggaaaggtctgaatgcagcgctcaatgaatctctggctcc

SEQ ID NO: 3637 - DNA, 433 bp, Homo sapiens
  Genbank Accession No. W88985
ttttaaggtaagaaagtttctgcttttattgaaaatttatatatgactcagtattgtaataaataaacataaccattttcacaaaaaatgacagtgctatgctaaagaagaaaatattaaatgggggatttacttgtagtggcaagacagactttttatcaatacagaataaatattaacagcattcgtgagccaatgttgagacccaacaaaatgtaggaatcaagcatgatgtaagaaataattatccagagaaaaagatggtgtattctcggatgataagactgtctttgtaaactggtgcatatcaattagtcccatcctcacagctcaccttcaaaccacagggcttgtttctggctatgttaaaggaccatcctctgaggaaagcagaggagaggaactccattatccttacagtgaaacgcaaccg

SEQ ID NO: 3638 - DNA, 367 bp, Homo sapiens
  Genbank Accession No. W89178
  unsure (1)..(367): n = a or c or g or t
gagactccatagggctcggcgtgggatgctgggaangcctgatgatgcaactggagggaactgggtttgattgaaggaagggaagccaggtgtgtaggggtctccagttcccaggtgcacatgtccatacactgcctgctgntnggacaggcttggcttgggtgggtcctgggagaagtccgctggctctgggtatatgagcactccttgagccccgaagtcctgagcattggtcaccttctgggcgaactgattcacccccacgcgcaccagcagcaggcggcccactggatccacgcccctggcccgcagtcctgcaggtcttcngggccgcccgtagtgggggtaacaccagctctcccgttga

SEQ ID NO: 3639 - DNA, 422 bp, Homo sapiens
  Genbank Accession No. W90018
  unsure (1)..(413): n = a or c or g or t
ataggctttgtttattaaaatcttttaaacattctaaacttcttgtgtaatttatcatatttaattttctattttagcacttcaaatcattgatatgacaagattataaccaattaagacaaaacattctcatatatttaagcatctcttgtaaatctaatacattaaacttatagtaaatctagtctaatacttttcatgagctaagttaaatattcttatacctttcaacttcaaatcacaaaccgtaaaatcaatttcacatttcaaattggaatcataagctttttaaagattcaaatcacttaaggagcatacacaagattaagtcctaaacttaacatggaaattatcaatattatggatttngaattattgcattatttccataatgaattctacacattcccagagttggaaaa

SEQ ID NO: 3640 - DNA, 413 bp, Homo sapiens
  Genbank Accession No. W90128
  unsure (1)..(413): n = a or c or g or t
gagacaggcttctctgctatcctccaggcagtgtaatagtcaaggaaaagggcaacagtattggatcattccttagacactaatcagctggggaaagagttcattggcaaaagtgtcctcccaagaatcggtttacaccaagcagagaggacatgtcactgaatggggaaagggaacccccgtatccacagtcactgtaagcatccagtaggcaggaagatggctttgggcagtggctggatgaaagcagatttgagatacccagctccggaacgaggtcatcttctacaggttcttccttcactgagacaatgaattcagggtgatcattctctgaggggctngagaggtgcttcctcgattttcactaccacattaagcttggctctctgtctcagagggtatctctaagn

SEQ ID NO: 3641 - DNA, 304 bp, Homo sapiens
  Genbank Accession No. W90146
  unsure (1)..(304): n = a or c or g or t
cacttatagccaatatttaataatcccatattaactgatgtgtaaaaaatgtctttatgatctgttaccacccaaaagaatgcatcataactttcaagantatgttctttgacttctaacctctgctcttctttagaattacctttgctgcggccagtacatgctccttgttaatgactctacatttactcgcacaagcgtttgtcctggactcttctgctaatcgatgaacaaacagtaaacagttcagatggaccaataagtcaccacttttctccagaccgaagttggagggcttctttcc

SEQ ID NO: 3642 - DNA, 434 bp, Homo sapiens
  Genbank Accession No. W90396
aatcaaagtaaatttatttctgaattacataaggatcatgaaacagaaacattaactctcatgttataaaaacagtagtaaaatacagtacacaggaatgtcaattgaatgacaacaatgaaagtacaatagcaaatgaaaaatagtaacttttaactttaaatacaaagtgaagcaatttaatatgaaattttgttaataagaaaaatatatgtcccatgtctttattacatactgtacaaaataaaatattgcacctttcatataataaatatatacaaagagtatgttacaaatcgatctttcttttaatttaataaccttcaacaatcagatgtgattggatgattaacaactaatcgggctgggtgtgtcctcctcactgtcccccatccattcccaatcaccaaaccctccacatacagtagtgctca

SEQ ID NO: 3643 - DNA, 410 bp, Homo sapiens
  Genbank Accession No. W90455
  unsure (1)..(410): n = a or c or g or t
ccaatacaactttatttatcaacatggaaatttacgttttatataatttttacatgttatgaaataatattcttttgtgcttctttatgaactatttaaatataatgccattctggccgggcgcagtgggaagagataccaagtccagcatcttcagacaggcagaaggccctgccttccactcggtgatggtgtcagggactgttactcctacctcagccacacctgctgaatttaccaccaccaaatcccagatccatgtctcagggaagtactttcgtacggtctccgtgtgaggctcttcaacatggcaccaggcgtgcatgggcctcctncccatttaacatctggactcnataaaaaccttacaccgtagaccnttaggncccatggcatttcntaatggtgaa

SEQ ID NO: 3644 - DNA, 351 bp, Homo sapiens
  Genbank Accession No. W90560
acagaagtttatctttattttctactgggtagaatttctagaagcttctttaaaaattgtggtttccttggccttaaagagtgataataacttttccctcagcataattctgccccaccctaaaacagcactgtgtctggtgcttcttgtttgtcccagtggcagcacctaggattaggtttcttcagtcttccttgtcatcccagcagtggaatcaaatttctttcagtgaaacatgtaaacgtaagacctgtgcatgtcttatgggagaaaatgtttccaggatgaactcactcagaggaggagacagcatttacagtggcgccagacaggcttgcagcttctacttgg

SEQ ID NO: 3645 - DNA, 478 bp, Homo sapiens
  Genbank Accession No. W90583
  unsure (1)..(478): n = a or c or g or t
tccattgcctcagttttaaatatttatttaaaatccagaggggaaaaggagaaacggaacccattggggttttaatacactgacatgtggacagagacgtaaacgaagacagcaggaaaacccaagaatgagacagaggccagtggattctnggcagcaggagggatccgagcgctgagatgaggcccgagctgctacaaacacgcacttccacgcagagntccacggctggggcggcagggcgacggatacagaagtgttggnnncgggggacgggccaaagtnaggtattnnataataaaaatcaaatccaattcccaaagagacacaactttaggagagaaatacacaaatagagactttcacatacattttccccttctataaaaataattccagggttaaaataacctcaaaatccaattcaagcggcngactttgttcgctgatggtagcacaattcaggngacgcttgaag

SEQ ID NO: 3646 - DNA, 464 bp, Homo sapiens
  Genbank Accession No. W90766
gtaattttttttaataaataaaagcacattaacaaaaaaggaaggtaagcagcaccggaagcctttgacgtttgtaactaaatgctggtactcaaatggtctagctggttaagtttcactaggaggcgcaaaaaaggagccgtttttgacttaacattttaattctagtagagataagaagagcttgtgtgggcttacagtccttcacctgactgtccttcaccagtgagtagcataccagttcttcaaatgtcctatactttggaaagcagacccgactctggagcactcgccttaattagattctgaatttccttgaattttgggatggtccttatcagctaccagctgaagcagaacagcctcactcgtggtcactatgatcccggttcgagcgagacgctcaggggcaaacatcctgtccatcatgcttcttgatgaggtggcatcagcaacaatgtgat

SEQ ID NO: 3647 - DNA, 171 bp, Homo sapiens
  Genbank Accession No. W92148
ttcctgacatctgtggttgtttatttaaaagaacagacaatatttaaaatgaaagacaaactcagaggttcaaatgcatccaataacttgaagcagcagtgacatatacatccaaagatgattgtagctatttaaagccatatcttgtttttctaggcaaaagtacaacat

SEQ ID NO: 3648 - DNA, 395 bp, Homo sapiens
  Genbank Accession No. W92207
  unsure (1)..(395): n = a or c or g or t
gtgttccaataaaactttatttacacacattgaaacctgaatttcatacaattttcacgttaccaaattttaattttttttcaactatttaaaaatgttaaaaccattcttagctcacaggctatgcgaaanagancaaccagccagattcggcccacggtttaaggccagtttaagcctcaccaccttcctagccccactcacctattttgtcctctcatcttcctgtccttcagcacccccatgaccttcctgtgaccttcaatggcccctccagctgccgtccagccctgtctgtctgcccttnggggaccctctcctcctgggctgcaggactgttttttcctggagcaggtctctaaatagctccattcgccttggcagggggaatccag

SEQ ID NO: 3649 - DNA, 241 bp, Homo sapiens
  Genbank Accession No. W92449
ttttttagattcatctttttaatgacatcctaaaattcagaggaggggccagcgggacctctgggctcagcggctgtgaaggagggacccgcaacacccgctaaggcaggtaattgcaagaaggcactcgcgagggggacttcaagcccctcttctatttcttcatataaaatcagggggatggggaaagctccaagggcgagggaagcagagagtttctctcccagcctatggaataagg

SEQ ID NO: 3650 - DNA, 118 bp, Homo sapiens
  Genbank Accession No. W92608
gagaaaatctagagacatgagggacataaatgggcctggcagcctcggtctttgcggctgctggcaggactgagctgtccgggttctccccacacttccagcacagctgtgtcatgtg

SEQ ID NO: 3651 - DNA, 375 bp, Homo sapiens
  Genbank Accession No. W92713
  unsure (1)..(375): n = a or c or g or t
gangaaaaaaaatgacaatgtgcttttattttttttcttgttaaaaaaaaacaacattggtaaatcgttttcattaaatagacctttgtgattttactgatttacatgagtggcactaaattacatgatttataaggcttgacacaggaaggatacactgaggtatatcggtaagaaaagggatatgaatactagagaaatgttaaattgataactaaggcacactttcggatgtgaatcataaatctaccactgtggctacgaacagcctatatgtacatggatttctgaaagacatgatcagttcgctgggtaaaagtaggagacgggcctggggctttctgccagttcccctggttacttgcccacaccact

SEQ ID NO: 3652 - DNA, 324 bp, Homo sapiens
  Genbank Accession No. W92771
  unsure (1)..(324): n = a or c or g or t
ccccatcggtaatactaaaagtttctattctaagtcttctatccaccactaatttaagacaactctgctggcttgcgttatttcatactagtttatttaggagttccattttcactcctcaatagattttatgtatttctcatatgcttcttcactcataagttcatctagttctgaagggttactcagtgtcatcttgatcagccaaccatcttcataacaagatttgtttacaagtcctggattttctgcaagagcttcattaatttcagttacttctcctggtaaaggggggaaatagaggttcactangcaggtntttca

SEQ ID NO: 3653 - DNA, 479 bp, Homo sapiens
  Genbank Accession No. W93726
  unsure (1)..(479): n = a or c or g or t
tgtagttcaataatattttattgtcaatagcataggagaaattcaatattgaatctcagaacaagaagaacctatttacaatgcatgtcaaggaagagatgggagaaggaatgtcacaaaattttttggtaaatacatattttttatagagaagtaatccatgaacctgcaacatggatagcttatccaaccaactttacaaattactattaatataagttacatgcttgccatctaaagtaactaaacccatagactgaaaaactatgtgtcaaggtaacgtgagcactttaatcactttacttatattttctaaaggcagtagtttcctctccttttcccgctatccatattaggatgaagagacaagttcctttccaacaccaaattctggatatcgggctattggtggaggaatccctggtggcgagtcagctagaagcccctggccacccaggnccaggtggccaacccaatgg

SEQ ID NO: 3654 - DNA, 562 bp, Homo sapiens
  Genbank Accession No. W93943
  unsure (1)..(562): n = a or c or g or t
tagaagaaaagagaagttactttattacaatttgttatctcatcccgaggtcagggccccttgcttagtgggaaaaaaaaccctttaggactgagtctcggaacagcacctgtcctaaacccaacttctctgtgatgcccggatttcttgattttgatccagtagctgctcattttcctgccttttacatttaggagattcaagctctgtcatttcctctagctgcccctgaagtccgtccttcctgcagggcccaactccacgtagagtgagtgcagccacacagcagtaaccagatagagcagcctcccctgcagacatgagcaaagaagggatccagagagccaaggctgtatcatagattcttgtggggtcaaaggggcagtcagtatgtcccggcccctcatccagtggtaccagaggatccagcagtcctggggtggcagtcagcaataaggcggcggccaccgttgggccacagtgagtgacacagcaagaaggaggcccagggagcaggcnacggacaagagcaggntcaccagagctagtgccagcaggaccc

SEQ ID NO: 3655 - DNA, 468 bp, Homo sapiens
  Genbank Accession No. W94281
ttttttttttttttttttttttttttttttttcagaagtaaaagatttttattgttctatagacacttctgaaaagagatctaattgagaaaatatacaaagcatttaagagtttcatccccagagactgactgaaggcgttacagccctcctctccaaggctcagggctgagaacggttagcatatcgaatgatcagtaaaaacatgcaaaagtgagaaggaaagggaaaaaggtgcattcccctaagctgagggggatggaatttcagaacagaggaggcagggtggacaagtaccaggtggctctccctttccctctgtgttatctttcaaaacagttccaagcttggagaaagcaatgagctccacctactcagcagaacccacggctcgtcccccgtggacgtgactgagcagtgaccttgcctgccccgttcctcagccgctccccctcgtgccgaattctt

SEQ ID NO: 3656 - DNA, 406 bp, Homo sapiens
  Genbank Accession No. W94427
cactaggaaacaaaggatattttattccttttttctgttgttgttgaggatagatcacgatacagagaacagcaatgggtcacagcgcacggtttggttggtttccgcgggaacacagaggacaggaggggcgggatctgggttgagttcccactctcgttatgaccttcaacctctcactgttcccaagggctgcacggagcctgctgagtctccaacccacctcgctcaccgctctgaccaccgacagcacgagaaacggatgcgggagttgcctctgctgcccatctaaggggacgtaggcagagaagcaaaggcctctgctctccctccatccatcccggtgtgctggccccaacggaacaggagtccttcaactattgcctgccagagacccaattgcagg

SEQ ID NO: 3657 - DNA, 506 bp, Homo sapiens
  Genbank Accession No. W94885
  unsure (1)..(506): n = a or c or g or t
tggccaaatgtcccacgtttatttacatatgaaatgtgtttcatacagttatgatggatggagtgcataacacctgacagcagcaagaccttttgaggaaccgaacattgactacagtatatcatgcaagtatctatatatacacaaaagaattccttttcttaaaaaaaaaaaaaaaaaaggtacaaaacatgttcagggataaatacaagatacaaaatgcaaaagaaaacacaaaacaaaaccaaaaaatagaactctctcagagaactataaacggaagggacagaagagtacctctgctgcattttaataaagcagaactaccgacgttaaatatacttcttggaaatggctgaactaaacccgggtggctcagtgcttaaggtaacggccaattggcaatacacaggcggctgcattgataagtcggtgggtttgaagttgtgcatcccggactctaagtaccataacgtttgggcagtagcacccngaacaggaacgcc

SEQ ID NO: 3658 - DNA, 174 bp, Homo sapiens
  Genbank Accession No. W94942
gtattatatttttattgttggcttaaaaaaattacttctttaacctccttaatttgtcagtttgtgggaggtgaatctcaatggcatcaaaagttatagtcttcttacacttgttaaaaataaagtgtttaaacaagtttgtttccattcacaaacttactcccaactacaaaa

SEQ ID NO: 3659 - DNA, 497 bp, Homo sapiens
  Genbank Accession No. W95041
  unsure (1)..(497): n = a or c or g or t
cgttggcaaaatatattttatttgttcatacaaagaaatagtatgaattaccagaatttcacttgcctagaaacatctttctctgtgtaaaattaatttgtgttatacataggacaaaatacttgatttaattttttgtacatattcggctatcctaacatccaagttatcgaagacatactgctagaatttgcacagtattttagattacttggttgaatgagactcagtgataaattaatgtcacaaaagtgagaaaacatctaaccacacctttaagttttattggccatcctcttgataagctgaaaagtcacattagcttctgtgtcagcatcttagatacgtactgtttctagtttattggaatcttccattttccttttttacaaaaatatcctgggcaggatctgaaactggtttctccaaatgtctaaaatatatctgtcacaccaaatgacccccaaagagaatccnggggaagaaaacaatttctc

SEQ ID NO: 3660 - DNA, 327 bp, Homo sapiens
  Genbank Accession No. W95348
ctggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacagggagct

SEQ ID NO: 3661 - DNA, 421 bp, Homo sapiens
  Genbank Accession No. W95477
ccatataaatcttttacttaaaagtcatataaaagaataaaaaatgcagatttctgaatcaactgtagataaggaagcaaatgatgttgaaaggtgcccattaatttaaaatttcatcataggaatttgggtgaccttttgcactcagtattaaaaaaaaccatcaagttgctctttggaacagtagcatttaggtttttttttttttttttttttgtcacacttgtttatttctttgggatgttgctgtgtgtcgtggaagaaacactcccctgaaaactgtaaccaaacaaagtttggttaaaacaaagttggttcctttgttttcatggaaatgtcagacaactatgaaaagctaaggaagcatgttgaactgaaggtctggctttggtaaattaggcagagatgttctcagcagcaa

SEQ ID NO: 3662 - DNA, 478 bp, Homo sapiens
  Genbank Accession No. W95795
cactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgactcctctctactttcatggacttgttcctttgtaatagtgcaatttggttttgttttatttggggttcattgtatgtttgggaatcaccaaaggcttttagagttctttggcaaaataaaaatatttgactaatcaaaaaaaaaaaaa

SEQ ID NO: 3663 - DNA, 436 bp, Homo sapiens
  Genbank Accession No. W95841
gagatggagtctcgctctgttgcccagcctggagtgcaatggcgcaatctcggctcactgcaagctccacctcccggattcacaccattctcctgcctcagcctccccagtagctgggactacgggcacccgccaccacacctggctaattttttgtacttttagtacagacggggtttcaccgtgttagccaggatggtctcaatctcctgacctcgtgatccgcccaccttggcctcccaaagtgctgggattacaggtgtgagccaccgcgcccggccaaatgcatgcttctttaatcaggccacacagccctcaacttcacagggcaggtgtatgcgagtcatctttggctttgtgcttcttacacagtcaatttcttcagtagcacatcacaaaattgaaaccataatagaattgcccaaagcctcgtgcc

SEQ ID NO: 3664 - DNA, 882 bp, Homo sapiens
  Genbank Accession No. X00129
cggccaggcttgcgcgtggttcccctcccggtgggcggattcctgggcaagatgaagtgggtgtgggcgctcttgctgttggcggcgtgggcagcggccgagcgcgactgccgagtgagcagcttccgagtcaaggagaacttcgacaaggctcgcttctctgggacctggtacgccatggccaagaaggaccccgagggcctctttctgcaggacaacatcgtcgcggagttctcggtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctgcagaaaggaaatgatgaccactggatcgtcgacacagactacgacacgtatgccgtacagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtg

SEQ ID NO: 3665 - DNA, 1761 bp, Homo sapiens
  Genbank Accession No. X00351
ttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttccccctttttgtcccccaacttgagatgtatgaaggcttttggtctccctgggagtgggtggaggcagccagggcttacctgtacactgacttgagaccagttgaataaaagtgcacacctta

SEQ ID NO: 3666 - DNA, 2209 bp, Homo sapiens
  Genbank Accession No. X01038
  unsure (1)..(2209): n = a or c or g or t
ctgcagacataaataggccctgcaagagctggctgcttagagactgcgagaaggaggtgcgtcctgctgcctgccccggtcactctggctccccagctcaaggttcaggccttgccccaggccgggcctctgggtacctgaggtcttctcccgctctgtgcccttctcctcacctggctgcaatgagtgggggagcacggggcttctgcatgctgaaggcaccccactcagccaggcccttcttctcctccaggtcccccacggcccttcaggatgaaagctgcggtgctgaccttggccgtgctcttcctgacgggtaggtgtcccctaacctagggagccaaccatcggggggccttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaagtaaggacccagcctggggttgagggcaggggcagggggcagaggcctgtgggatgatgttgaagccagactggccgagtcctcacctaatatctgatgagctgggccccacagatggtctggatggagaaaccggaatggatctccaggcagggtcacagcccatgtcccctgcaaaggacagaccagggctgcccgatgcgtgatcacagagccacattgtgcctgcaagtgtagcaagcccctttcccttcttcaccacctcctctgctcctgcccagcaagactgtgggctgtcttcggagaggagaatgcgctggaggcatagaagcgaggtccttcaagggcccactttggagaccaacgtaactgggcaccagtcccagctctgtctcctttttagctcctctctgtgcctcggtccagctgcacaacggggcatggcctggcggggcaggggtgttggttgagagtgtactggaaatgctaggccactgcacctccgcggacaggtgtcacccagggctcacccctgataggctggggcgctgggaggccagccctcaacccttctgtctcaccctccagcctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggaagcagcttctttcttttgggagaatagaggggggtgcggggacatccgggggagcccgggaggggcctttggccctggagcagggacttcctgccggatctcaacaactccgtgcccagactggacgtcttagggccaagatcgacgttggaggacctgctggacgcntggctgcttacgagtgagggagtagagtctgccttagcaaggctcaagtagaaaggaagtcacagcggacnaggcaaagccacagacaatccaaggccaggtgccctgaaaggggctcaaacaaggcctgcag

SEQ ID NO: 3667 - DNA, 558 bp, Homo sapiens
  Genbank Accession No. X01388
gaattctttttttttttttttttgttgctcagttcatccctagaggcagctgctccaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatg

SEQ ID NO: 3668 - DNA, 5180 bp, Homo sapiens
  Genbank Accession No. X02160
accgggagcgcgcgctctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgacgggcaggatgcatgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaacatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgacgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaaagaaaaagaaagaaaaaacaaaatggaaaaaggaaaaaaaaaaagaactgagatgacagagttttgagaatatatttgtaccatattta

SEQ ID NO: 3669 - DNA, 2026 bp, Homo sapiens
  Genbank Accession No. X02176
cagcatgtcagcctgccggagctttgcagttgcaatctgcattttagaaataagcatcctcacagcacagtacacgaccagttatgacccagagctaacagaaagcagtggctctgcatcacacatagactgcagaatgagcccctggagtgaatggtcacaatgcgatccttgtctcagacaaatgtttcgttcaagaagcattgaggtctttggacaatttaatgggaaaagatgcaccgacgctgtgggagacagacgacagtgtgtgcccacagagccctgtgaggatgctgaggatgactgcggaaatgactttcaatgcagtacaggcagatgcataaagatgcgacttcggtgtaatggtgacaatgactgcggagacttttcagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagactcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagaaaaaaaaaaaaa

SEQ ID NO: 3670 - DNA, 1843 bp, Homo sapiens
  Genbank Accession No. X02750
ctgcaggggggggggggggggggggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcgaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacgaaaaaaaaaaaaaaaaaaaaaaaaaaaaaaaaaaaaaaaacccccccccgccccccccccctgcag

SEQ ID NO: 3671 - DNA, 1582 bp, Homo sapiens
  Genbank Accession No. X03168
cagagcggagacttcagggagaccagagcccagttgcaggcactcagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtaatcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttgaccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcactactggctgggctgcccagctcctggccatctgtaggagtcagagcccacatggccgggccctctgtagctccctcctcccatctccttcccccagcccaataaaggtcccttagccccg

SEQ ID NO: 3672 - DNA, 505 bp, Homo sapiens
  Genbank Accession No. X03342
ccgaggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttc

SEQ ID NO: 3673 - DNA, 2532 bp, Homo sapiens
  Genbank Accession No. X03350
agtgcactcaagcagagaagaaatccacaaagactcaccagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacgagatctggagcaacagctaggaaatatcattaattcagctcttcagagatgttatcaataaattacacatgggggctttccaaagaaatggaaattgatgggaaattatttttcaggaaaatttaaaattcaagtcagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccaagagttctaaatacaggaaatttcttaggaactcaaataaaatgcccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaattttgctgatgaaagtgcttcattgactaaacagtattagtttgtggctataaatgattatttaggatgatgactgaaaatgtgtataagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatca

SEQ ID NO: 3674 - DNA, 1553 bp, Homo sapiens
  Genbank Accession No. X03453
tgcgcagctggacgtaaactcctcttcagacctaataacttcgtatagcatacattatacgaagttatattaagggttattgaatatgatcaatttacctgtaaatccatacagttcaataccttagcaggtcaaatagtgaccacttgatcatttgatcaaggttgcgctacgtaaaatctgtgaaaaattggcggtgttagtcctacagatttcgcgtaccacttagcaccaccaatcaatcagaggtgaaaaatgggatattcaactgctaaagtgtccactcatcttgagcttgagaaaaaccgtggttactggcgggcaaaagggtttgatcgtgatagttgccaactgtcattatcgcgcggtgaagagaaaatagaacgcacgcgcggtcgctggcgtttctatgacgagaaccataaacaggtaaaggcagagccgatcctgtacactttacttaaaaccattatctgagtgttaaatgtccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattagccattaacgcgtaaatgattgctataattagttgata

SEQ ID NO: 3675 - DNA, 632 bp, Homo sapiens
  Genbank Accession No. X04085
gtcccagggcggcctgaaggatgctgataaccgggagccccgccctgggttcggctatcccgggcaccccgggccggcggggcgaggctctccaattgctgggccagagcgggacccttcctttccgcaccctcctgggtatctccggtcttcaggcctccttcggagagccctgctccgagcccattgggcttccaatcttggcctgcctagcgccgagcagccaatcagaaggcagtcctcccgagggggcgggacgagggggtggtgctgattggctgagcctgaagtcgccacggactcggggcaacaggcagatttgcctgctgagggtggagacccacgagccgaggcctcctgcagtgttctgcacagcaaaccgcacgctatggctgacagccgggatcccgccagcgaccagatgcagcactggaaggagcagcgggccgcgcaggtacactctgtgctccccgagcgggcccgaaggtccgtttagaaagcgggggcgtcggcaagtaaaggcccggcttctcccggggcggcgcttggagggactgtaccgcggctcactgggcaggggggatccccttcggtgcagacggacttttacattcgccgaagcaggggagggg

SEQ ID NO: 3676 - DNA, 1558 bp, Homo sapiens
  Genbank Accession No. X04325
cctctgggaaagggcagcaggagccaggtgtggcagtgacagggaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctgccatccatccccgaccctgccctgggcgaagccctcctccttctcccctgccggtgcacaggcctctgcctgctggggattactcgatcaaaaccttccttccctggctacttcccttcctcccggggccttccttttaggtgctggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctggttttctggagtcacagtcagtgaggaggatgtggtaagaggaggcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggtggtcaaggccacctctgcctctagtccccaaggcctctctctgcctgaaatgttacacattaaacaggattttacagt

SEQ ID NO: 3677 - DNA, 924 bp, Homo sapiens
  Genbank Accession No. X04347
tttgaacagtatggaaaaattgaagtgattgaaatcatgactgacccaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggcaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaagcttggcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgaaagcattccaacaaagggttttaatgtagattttttttttttgcaccccatgctgttgattgctaaatgtaacagtctgatcgtgacgctgaataaatgtcttttttt

SEQ ID NO: 3678 - DNA, 2693 bp, Homo sapiens
  Genbank Accession No. X04654
gcgagacgaaggtgcgcaggccgatgcccgagagcgggatgatgaccgtgaagacgagccagccggcgatgagggtgaaggccacccagcgccacttgcccagcggcaccgcttctggcgcgcgcccttgcccttgatggcgacgaacttgttggccgagcgcacgagccagcgctgcagcatcaccagcggcatggtcaccgccaccaggcacacggccaccgccgccatcaggtgatacgaaggcgtacccagcttgttggtgagcttgtagagataggtcggcagcaccaggtggccttccggatcacccagcaccagcaccaggccgaacacttcaaagccgaggaagaacaccagcacgccggagtaggccagcgccggggtgatcatcggcagcgacacgttcaacgccacctgcagcggcgaacgaccggccacgcgggccgcttcttccacatccgaacccaggctgcgcagggccgccgaggcatacaggtagacgtgcggcacgtgggtcaggccggcgatgatgacgatgctggtgaaggaatagatgttccacgggtcgccctcgaaaccgacgaccgacagcaggttcttgacccacaccgtgtagaagccgaccggccccatcgagaccacgtagccgaagccgatcaccagtgggcgagacgaagatgggcaccatcagtggcgggggcggatcgaacgctgcgacccggcaggtcggctgcgcaccatcaggaaggccaagcactcggccgagcggcacggcgatcagggccaggccggtcgccagcgtcaagccgattgacgaaggcctggcggaagtccgggtcatcgaagatgaagcgataggaatcgaaggtgagcgtcttgaccggcgcaaagaacggcgccgacaggaagctttgatagaagatcagcagcagcggcagcgaagatggccagggctgccagcagcacgaccaggccgcgcggccagttcagccggaatcggcgggcggcagggcttgctcgcgcgcggcacgttgtggtggctgagcagcggcttggtgcgctcgtctagcgggcgacggaatcagacggacgtggacgcccccggagtggaagccgaagcaggagttgttgttgctgaggggctgccgcagccgccgcgagcctccggacagacgccagagcgaggaggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgatagtggg

SEQ ID NO: 3679 - DNA, 284 bp, Homo sapiens
  Genbank Accession No. X04729
acagctgtgtttggctgcagggccaagagcgctgtcaagaagacccacacgcccccctccagcagctgaattcctgcagctccgggcagccgccgccagagcaggacgaccgccaatcgcaaggcacctctgagaacttcaggatgcagatgtctccagccctcacctgcctagtcctgggcctgacccttgtctttggtgaagggtctgctgtgcaccatcccccatcctacgtggcccacctggcctcagacttcggggtgagggtgtttcagcaggtggcg

SEQ ID NO: 3680 - DNA, 1702 bp, Homo sapiens
  Genbank Accession No. X04828
ccggcagtcccgagtgcttcccgcagagggctggtggtgggagcggagtggagtcgggcggggccgaagccgggccgtgggcgtagatgggggccgggcggcggcggagcggcggaacgcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggaaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgaatttgtaccccccaacccctgaggaagatgggggcaagaagatcacgctccccgcctgttcccccgccgcttttctcctctttcctctctttgttctcagctccccctgtcccctcagctccaaacgtaggggaggggttcgcacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacgggagcctcctgcccagtcccccaaccccagccgctcggaggccccaaaggaaaaagcacaagaagcgtgagacgccaccattcctggaaaccacagtcc

SEQ ID NO: 3681 - DNA, 1989 bp, Homo sapiens
  Genbank Accession No. X05409
gctctcggtccgctcgctgtccgctagcccgctgcgatgttgcgcgctgccgccgctcgggccccgcctggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcacgtgaaggccgcccgggcgccttccagctgggctcaccttggcgccgcatggacgcatcacacagcggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggtgcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctct

SEQ ID NO: 3682 - DNA, 2212 bp, Homo sapiens
  Genbank Accession No. X05610
ggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccatccaaccagggacagtgggtccccaggggaggcgaggcccccctggggcaccgggggagatcgggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaaccaaaaattggttttatttttttcttaaaaaaaaaaaaaagtctaccaaaggaatttgcatccagcagcagcacttagacctgccagccactgtcaccgagcgggtgcaagcactcggggtccctggaggcaagccctgcccacagaaagccaggagcagccctggcccccatcagccctgctacgacgcaccgcctgaaggcacagctaaccacttcgcacacacccatgtaaccactgcactttccaatgccacagacaactcacattgttcaactccttctcggggtgggacagacgagacaacagcacacaggcagccagccgtggccagaggctcgaggggctcaggggctcaggcacccgtccccacacgagggccccgtgggtggcctggccctgctttctacgccaatgttatgccagctccatgttctcccaaataccgttgatgtgaattattttaaaggcaaaactgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccaccttgtccctgagatttaacccctccactgctgggggtgagctgtactcttctgactgccccctcctgtgtaacgactacaaaataaaacttggttctgaatattttt

SEQ ID NO: 3683 - DNA, 4414 bp, Homo sapiens
  Genbank Accession No. X06562
ccgcgctctctgatcagaggcgaagctcggaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttactttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgagtctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgataatgtgcttctgttatcaaacaccaacataaaaatgatctaaacc

SEQ ID NO: 3684 - DNA, 543 bp, Homo sapiens
  Genbank Accession No. X06617
caggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacattcggcccgctcccacaatgaaataaagttattttctattcc

SEQ ID NO: 3685 - DNA, 2520 bp, Homo sapiens
  Genbank Accession No. X06700
  unsure (1)..(2520): n = a or c or g or t
gctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcatatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccagggcctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccttattatggagatgaaccaatggatttcaaaatcaacaccgatgagattatgacttcactcaagtctgctaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaacagtgcaaggtggaccgacaaaattccagttattatttccaaatgtttggaaacagtataatttgacaaagaaaaatgatagttcccttttttgctgttccaccaaatacaattcaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcatgattaatctcctggaagattggtttaaaagaaagtgtaatgcaagaattaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcaccggcatgccacaggggattctcctccttcatcctgtaaaggtcaacaataaaaaccaaattatggggctgcttttgtcacactagcataggagaatgtgttgaaatttaactttgtaagcttgtatgtggttgttgatcttttttttccttacagacaaccataataaaatatanattaaaattca

SEQ ID NO: 3686 - DNA, 1550 bp, Homo sapiens
  Genbank Accession No. X06985
tcaacgcctgcctcccctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaaggggtcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctg

SEQ ID NO: 3687 - DNA, 3089 bp, Homo sapiens
  Genbank Accession No. X07173
gaaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggaccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatg

SEQ ID NO: 3688 - DNA, 1449 bp, Homo sapiens
  Genbank Accession No. X07618
gaccgcccgcctgtgcccatcacccagatcctgggtttcgggccgcgttcccaaggggtgttcctggcgcgctatgggcccgcgtcgcgcgagcagaggcgcttctccgtctccaccttgcgcaacttgggcctgggcaagaagtcgctggagcagtgggtgaccgaggaggccgcctgcctttgtgccgccttcgccaaccactccgacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggtgagagtggctgccaggtggggggcaagggtggtgggttgagcgtcccaggaggaatgaggggaggctgggcaaaaggttggaccagtgcatcacccggcgagccgcatctgggctgacaggtgcagaattggaggtcatttgggggctaccccgttctgtcccgagtatgctctcggccctgctcaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagccctaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctcctagcccagaggctctaatgtacaataaagcaatgtggtagttcc

SEQ ID NO: 3689 - DNA, 1270 bp, Homo sapiens
  Genbank Accession No. X07619
ccgccttcgccgaccaagccggacgcccctttcgccccaacggtctcttggacaaagccgtgagcaacgtgatcgcctccctcacctgcgggcgccgcttcgagtacgacgaccctcgcttcctcaggctgctggacctagctcagggagggatcgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagcgtgagcccagctggggcccaaggcagggactgagggaggaagggtacagctgggggcccctgggcttagctgggacacccggggcttccagcacaggcgtggccaggctcctgtaagcctaacttcctccaacacaggaggaaggagagtgtcccctgggtgctgacccattgtggggacgcatgtctgtccagtgccgtgtccaacaggagatcgacgacgtgatagggcaggtgcggcgaccagagatgggtgaccaggctcacatgccctacaccactgccgtgattcatgaggtgcagcactttggggacatcgtccccctgggtgtgacccatatgacatcccgtgacatcgaagtacagggcttccgcatccctaagggaacgacactcatcaccaacctgtcatcggtgctgaaggatgaggccgtctgggagaagccctaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctatgagctttgtgctgtgccccgctagaatggggtacctagtccccagcctgctcctagctcagaggctctaatgtacaataaagcaatgtggtagttcc

SEQ ID NO: 3690 - DNA, 2363 bp, Homo sapiens
  Genbank Accession No. X07732
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtaaggacaagggcccccagactcacagttccagccctgaggacaggggttccctcatccccccacccagcctaatgcccacctcctaatagaggggttcctggggacctgaagagggggcactatgacgtctccccaagcacctaggtgttctgtcctgctcttccttcagactcagccgttggaccccagtcctttcctccccagacccaggagttccagccctcaggcccctcctccctcatactagggagtcctggcccccaaattcctcctttcccaagacttatgatttcaggtcctcagctgtctcctccctcaaaccgggatcctcagtcccctgctccaccaggctcaggcatgggggtccccatccctgcaaatccaggcgtccccccgctgctggtcagacactgaccccatccttgaacccagcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgatt

SEQ ID NO: 3691 - DNA, 2549 bp, Homo sapiens
  Genbank Accession No. X07767
  unsure (1)..(2549): n = a or c or g or t
cagtgngctccgggccgccggccgcagccagcacccgccgcgccgcagctccgggaccggccccggccgccgccgccgcgatgggcaacgccgccgccgccaagaagggcagcgagcaggagagcgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagtttgtt

SEQ ID NO: 3692 - DNA, 1743 bp, Homo sapiens
  Genbank Accession No. X07820
aaagaaggtaagggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctctttcgcagttaaagaacatggagacttttactcttttgatggcccaggacacagtttggctcatgcctacccacctggacctgggctttatggagatattcactttgatgatgatgaaaaatggacagaagatgcatcaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggacctccccctgcctctactgaggaacccctggtgcccacaaaatctgttccttcgggatctgagatgccagccaagtgtgatcctgctttgtccttcgatgccatcagcactctgaggggagaatatctgttctttaaagacagatatttttggcgaagatcccactggaaccctgaacctgaatttcatttgatttctgcattttggccctctcttccatcatatttggatgctgcatatgaagttaacagcagggacaccgtttttatttttaaaggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcctgttcctt

SEQ ID NO: 3693 - DNA, 7530 bp, Homo sapiens
  Genbank Accession No. X12447
cacgcctgtagttcagctactcagaaggctaggcagaactacttgaacccagagtggaggttgcagtgagccaagatcgcaccattgcactccaccctgggcaacagagtgagaccctgtctcaaaaaaaaaaaaaaattaaaaataggtaaattccattttcaaagatacctgtaaagatttttaaaatcattcatgaatgcggtctgttcgttgcacagagtagatgctcaaaaatggtgaatgagaccctctattttggtctcatgctgaagaagtccataaagcccacaagtcattttcatgatggacagaaaaatgtgtgtgctttctctgtctactgcctcaactgcacagaccccgggactgtagcagaaccatcttttgagcttgacaccgggaggcccaaattctagcacgggacctagggccagttgctctctggtcctcagtctcctcacccataaaatgggaaggagagaaccctgaatcattgcttctagcttctgaactcagttgttcagaacaaggactcactgctgatttttcaacagcacagggaattgcactgttcctggaatgatggacagtaccctctgttccactgggcaagtgagatttcccaggcctctctgttcccttctccccttagagagcaacagacgtgtggccccaccacctccctcaaccctctctctcctccctcaggactgggcacctcgctgcccccgctgctgcccactctgcgactgtgcctgtacgtgccagctccccgactgccgagacctcaactgtctctgcttcgagatcaagctccataggacccaggcccctgcctctggggagcggccagcccccaggcccatgtgccctcctccctgaagagcctttccccacgccactggaaccacagatggcctgccgagcacccaggcctgggaactggaatggcagcgcagggcctggctcctgcagggcaggactcttggccggctggacggcagctcctctggagggccagaaaagagagggctagtgctcggcagtgccctgcttcccttcccctccacacgtcaacgattctatttgaagttgggcagggggtggcgctgctcaccacacacaagtgttataggaggagtctggccccgtagtaccgggtacgcaggggtgcctcaaccacactccgtccacggactctccgttattttaggaggtagatgtagtgccagtatctactctccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggtgagtgggcaggggctctttgtccccaatcaatcagggccgacccaagtcttcctcccccttccccatgccgggccccacgatagtgtgaatgtcaggggcttcaggtttccctaaatataggtccctgccagaggatccgtggcgggaaaagggcaggggtcattagagaagatcggggacacatgtggggctgggcaggagctgccttataaccacccgggaacccctagctcactcgctgctgaccaggctctgccggctccttgccctcgccgcaggtgggccccttgcaggaccggccgggtgggatgggttggaattgggccaacaggtccagatgggtccaggtaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccgtgcatagccgcgcattctggttttctgtggcgcagaggactaccagcctggctgcggcggcccggcggagaccgccaccatgcgcgacccagcccgcctgccagcctggaactcggatggggaggtctgcctccgcgcgccgctagtttccgaccgccttctcgctcccctgctgtcctctcgatgccctttcctccgcctcccttgacgcctgggccagtgacaggtgtcgtccgcgccgattcagcccgcgggcgaggcagctaacgcacgactgcgcgatgtggcccctatggtgacacgctgcagccgcgaagaccggaagctggggccccgggccgcgcgcgctgggcctgggaggcgaaactcagcttccttcgtttccgacttttccatccgcgtcctccacttccccgttccgccctcccccattgccaacattctggctgagatcagcgcccagagcgcgccaggctgggggaaaggagcagaagggagggccctagcgacccgcgggatgtggtccgagtcacgtccgagggggtggggagggatcgtgttctcgcgcccgccccttcctagcgcggcctctggctcgcctctcgggggcggcccgtagcccagtccgtcgcctgccattggacgccgcccgctcctcgtaaaggaaaaagctcggcggagggcggagtggtgcctttaaaaggccggcgccgccttccgcctgcaccgcctcctgcgccgccccttccgaggctaaatcgcttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttgcggggacccagggaccgtggagagggtcttgggggcagtggcgggttggcgtccgcgtggaggcctcccccattcgcgcccatgccagcgtctccccactaccaggcacacacaggctccccggcccctccagcctgaggtcctctaactgcgcaatgcagctgcgcgcgctgagtcatggcggggaggaagccggacgagatgaaggaccattctcccccttttcttgcagggacccctgtggcaaaggattagggccccttaccgctggcgtggatcctaagaggcagtgaggggtgggggccggcccatgtacagccccagggttctcgcaagtgggagcttggtttctgtcctgggaaacgggcgcccttcgcgaggagggaaacccctcgcgtgcttgatgcccccttaacactttccctgtctctccttatcgggcgaccattgattctgagcccggaacagctgcagccatgcgaagcgacgggagcatttttcaggggaaggcgcttgctcctccacgttcttgccccgtaggaacagtgacgatggcaaagcttaccgctttcctgcctgggctagggctagttccgccgccctttcctgggcttctccttgctctcttatatttttcctaatgcccctttcctaccacccgccccctccttgtggggaaaagcctgaccttgggatgtccttgaagccttggagcccgggccagccctgggatcttgaggggattggaaggaacacccagtggcagtcagaagagctgggttctaacctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatgctatggccttttcctttcccccagttgccagtgggcaactccaccctcagctgggcaacacccagcaccagacagagttaggaaaggtaccggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggaactgtctgacatcgctcaccgcatcgtggcacctggcaagggcatcctggctgcagatgagtccactggtcgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaaccccggcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagtaggaagtggaggaaggaaatccaggttagtgaggcagggaatgaatgctggattggtggcctagagacttgcatggagcctgcttcaggcttagggcatttactcgacattttttatcctcacaattctgagagaacagtatcattcccactttacacatgaaaatctcagaagctcagggaagtgaagtgttttgctcagagtaagtggcagagcccagtctgacacccaattcactcaacatttctgttgtcaataacatcccagtgtatcctgtctcagaggattgttactaagtgaactaagtgaaaatattttaatttaattgtaactaagtatttgagtaactaaacattttaagtaaatttttattttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctccctaagtgctgggattacaggcgtgcagccatgcccggcttaagtaactaaatattttaattgtaactaagtgaaaatatttgccagccctgaagatgcagtttaagggattaacgtaaaatagtgggggaagactggggctaaagaagaggaaagaggggcacgccagctacctaggaggctgaggcgggaggatcacttgagtccaggaaggggaggcttcaggtgagctgagattccaccactgtactccagccgaggcgaaagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctcccaccctgctctgaccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtggcctgcaggtcctcaataggcaacctcctacctcatttggttccagtgttgttaatttgcctattaactgccatgatgcctacctccccaaaagcaagcattagctttggcgcgtggaggcactcaagggctgttgaaggcagaggggccaaggagggatggtgggtggatctgaggcggctcttgtctcctgtaatctagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggcccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctcaggtgctggctgctgtctacaaggctctgagtgaccaccacatctacctggaaggcaccttgctgaatcccaacatggtcaccccaggccatgcttgcactcagaagttttcacatgaggagattgccatggcgaccgtcacagcgctgcgccgcacagtgccccccgctgtcactggtgaggcccactcatcttgatctctatgcagtagataagctccacccacaaccctatgcccatttggacggatttcccatggcaacttccaccagctcctgccagcttcctgggtctctgacacagccccctctgctaccccctgcactacagggatcaccttcctgtctggaggccagagtgaggaggagtcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggggaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctggggctccaggctggcttgccgcgctctttcttccctcgtgacagtgttgtgtggtgtcgtctgtgaatgctaagtccatcaccctttccgggacactgccaaataaacagctatttaagggggagtcggccgtccgtgtcttgtggtgtctaatgcaggggagggcctggggaggtagcagagcccagaagaagaaagagcccctgttctctgttttttctgggcagaaaaggagtgaaaggtggaaggaccttcctgctctgttttatacttggccagggcttcaagaaaggctgagagctgtgacattttcttcactgcagg

SEQ ID NO: 3694 - DNA, 1196 bp, Homo sapiens
  Genbank Accession No. X12662
ttggtataaatataaatatggtattttgaaacagaactgcatcggacacatggtaaaaactcaatgttagctatttttatttctatactttgattatgatatgattctacaattattttcctgtacaccatacttcaaaaatggtaacctctctgggttaccaatcaagtaactaattttttaaagtaatcatcaaaaaaggaagttatatactctttattatattataccctaaaagtttatgaaatgtgtctcatggattaaccatttaccctcatgtgtgaaatctcaactcaggattttagggctggaagggatgtgacagacgatcttgccaagcccggcccttcttctacaaggacgtcttcagagatctggaggaggaaagggccttgccctgagttcgctgagccagaacaataggacttcttctgtagttgtgaaacttgtcagttgttgaagtcaggttaatgtcatctggctggctttttaaaagggtgtgaagtgagaacatgaataattgtcacttgattagagacctagactcagagttaggttactccatgtatgaagtaaccccatatagttacttcatacatggagtaaccatatagttactccatgtatgaaaaattgcaagactgttgactgtcattctttggtttagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacaggtaaggaaaaaagtctttctttgaattcctggaatttagttgaaaattttggacttcaaaatttgtaaggtgttattgtctagttagttcagttttctgatacatctggccaggaaatgcatattttaaagtcctctcacattttccaacattgtataattatagtcacatatccacttacttttgtggctcgtgatctcagccaaggctaaattcattgaacctacagaatgttttctcatattttttaggagaaaatatttttctttgaattgaaatggactctttctgcattgtagctactcattgaggtttagttgctcttgttgtttttg

SEQ ID NO: 3695 - DNA, 1633 bp, Homo sapiens
  Genbank Accession No. X13227
ttggggtccattgcaacccgaggcgagactagagttcccaagcgagaagggaagaggcagtgggtgcacgtggaaggcggacagagggctggaaacaagacgctccagaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactgcacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaagcaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacraagtcagtgcctggagaagggttcagcccaacatggggcccctctcatcactgaaatccctctaccttctctgggtctggcattataaagaacagctgaggctgtcattccatgagtcttcagaagaaaggacagctcagaaagtcaaagaggccaactgcccagagccacagaaaatggaggataattgaggctaagtaacctgattacaagttgtactaacatattaaaggttctgaaaagtcctgcaaaa

SEQ ID NO: 3696 - DNA, 1367 bp, Homo sapiens
  Genbank Accession No. X13334
ccggccggccgaagagttcacaagtgtgaagcctgaagccgccgggtgccgctgtgtagaaagaagctaaagcacttccagagcctgctgagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaac

SEQ ID NO: 3697 - DNA, 1748 bp, Homo sapiens
  Genbank Accession No. X13930
gctaccaccatgctggcctcagggatgcttctggtggccttgctggtctgcctgactgtaatggtcttgatgtctgtttggcagcagaggaagagcaaggggaagctgcctccgggacccaccccattgcccttcattggaaactacctgcagctgaacacagagcagatgtacaactccctcatgaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgcccaccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctacttgaaaaacctggtgatgaccacgttgaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagggcaccgaagtgtaccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaaggggctcagttcaccttgataaggtgcttccgagctgggatgagaggaaggaaacccttacattatgctatgaagagtagtaataatagcagctctccaattcctg

SEQ ID NO: 3698 - DNA, 1163 bp, Homo sapiens
  Genbank Accession No. X13956
accccccccccccctgcttgggaggctgaggcaggagaatggcgtgaacctgggaggtggagtttgcagtgagctgagatcgtgccactgcactccagcctggccgacagagcaagactcttgtctcaaaaaaatatagaattaaactaaattaaaaaataaatggaaccacccagcccatcccctacccacctgtcctgcattttttttctccttatcactgtctcaccactagaggccagctccaccagggcaagggtttttccctgcctgccactgtatgccgagtgtccagaacaaagcctagcacaaggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcaagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggccacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttcttccctgtc

SEQ ID NO: 3699 - DNA, 6483 bp, Homo sapiens
  Genbank Accession No. X14487
aagcttctaattgcagttcaaccacctgttacatatcttcaggaaaaaatcacaacctctcaacttcaacttcctcttctataaattagaaataacaataaccacacctgtaaccccagcactttgggaggccaaggcaggcagatcaagaggtgaggagattgagaccatcctggctaacatgatgaaaccctgtctctaccaaaaagacaaaaaattagccaggtatggtggcacacacctgtagtcccagctactcgggaggctgaggcaggagaatggcgtgaacccgggaggtggagcttgcagtgagccgagatggcgccactgcactccagcctgggcgacagagcaagcctccgtctaaaaaaaaaaaaagaaagaaagaaagaaagaaagaaaagaaataataataaccaccattcctatctcaacagcttgttctagaaatttttaaagcacagtatcacaaacagcactacataattgtaaaacatgtatgaatatatacatccaaacaacagcaatgtcatagcctatgggtagatataatcttatacaatgtaccaaaatcccaatttacttcactagacaaactgttataccaaattctgtacacagtatatccaagaaaatgtgttgtttttattgagaaactgaacctagcttgggaacacatgtgcacagtctagttcataatatttggtgcaagtatcattctctaatatagatttacatttttgcaagcaaatttttacttgcaatcgtaacatatccaaattttccctttttactcaatcagaacttagtgtaaagtactacaagttagttcttcggatttcatgctaagaaaataatgcagattttctgcattattatggtcttcacagaaaccttaactatgatgaatttaaaagtgcaaaataatccaggataactttatgatttcacattttttaatgttaaaaataatgccatcattaattagaaaattctaaaatcattacttccactttcttaggcaaaatatcaatatactctcatttgccaaataaattaaaagatctcctacaaacacaatctcctaaattgtggttttatggctttaatgttttatgtgtggcaactattgatgctagttaaaattttagaaactctttctttttgattccctacagttgtctacaagaaccttattgtagcatgatcctgccagactttatactatttgttgctccaattaaaactgtttaaaacatgaatttgaaaaatcttattttaactataattttgtagctgaaacttttttttctaaactttgcaaacattctatgcaacctgaattagtgctgagaaaattggatcttaatggttgctcaatgttcttcaacaggtgaaaagcataataaaacatgctcatctgaactccacccattttcaatttcaacatagcatacctcgtgtttattcttagggcaaattcaaaattgtacatattaggattggttattactgaagataatttatgcaatcataagccaaagatgctaagttggcaaaaagaaaacaatgtaagtaagcaaactctaacacatgtggacacaccctctcagtatataaaggcttgtcactgtccttggtagcaggcactccctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggatgctttgggggctcatcaggtggctatggaggattaggaggttttggtggaggtagctttcatggaagctatggaagtagcagctttggtgggagttatggaggcagctttggagggggcaatttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcaggtaagaggtatttttaaatccagctttaagtatcttgtccatgtaatccagacagatgaatcttaaattaagcacaatgtggctgttcactatgcttacccatgttactttcttccttcaaaaataacccagtctcatcaaagataaacatctgtgaaactatggtcatggcaatcttcatccagcaagtgtgctacttgtcttaagaggatgggagatttactaagcacttttgaggttttaatgagcatacaatgagtccacagttaaaatatgctaggctatttacaaatgtagaaactgaaaaaaaaaatcatgatatgaatcagaacaaaatgttattcagactgataacaagccatattcagtaccaacatggcaagaaaaataaattttccagtatgaaaatgggacactgcttgcttctaaggaatttctgaattgtacctattgtgtaccagttcagagtgtatttatttattagtatttatcatgagttaaacaaatgcaggtgtgagtcagccaaagcatggctgaaatacatggaaatcacatagtctaaaagaggagggcacacttacaggaatacatctatataattccagttagttttcagaaaggaataattcgtgtacagaaatacaagactggagaaattccaagagaacaaataattcaaagttaagtatatgggtaagcctgcaatatttcatatttaaaataaaaaattttcccaagattttgtaagagaacaacataaaagtgcagagtgcatctatgtcactacaaaagccatatctgcatctgacctcttctcaaataactgtgcctctccctccagattctcaacctaacaactgataatgccaacatcctgcttcagatcgacaatgccaggctggcagctgatgacttcaggctgaagtaagttaagtgatcgttgtataatactatcacaacgaatacatcagtggtttttaacaatgacttgggatgccctcaataacatttacatttttctgaattcacccaaagttaaatagtattggagttatctgagaaattttccatgtcagtgttacctttttggcaatattaaaggaagaaaatgcatattaaagtaactgctaaggttttttccattaaaccactattacttctaagagaactgtacatgacaaatattgccattacatgagatcaactatgtagttgctttttaaatagtctctgcccagatacatctcccctatataagttataaccagtattgatatcatgcttgtttcaggtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggtgacacaaaagttatacttttcccagccaaaagagagttcattatggtcctcgtgtagccaataaatctttctgttcctcaaacaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaaggtaaagtaatcttccttatagtgaaactcatggaggttttatcatttcagaatttcctcacccttttccttgtttttaatactctagagcaaggaactgactacagaaattgataataacattgaacagatatccagctataaatctgagattactgaattgagacgtaatgtacaagctctggagatagaactacagtcccaactggccttggtatgttaactctcatgaaatgacttcaactttatcatacaaagtttcatgctcacctaagaatatgcaatgcaacaaaaaaatgcagagttggaggtaagaaagagaaaacaaagtgaagctcatgttaatggaggaaaagtactactagtgttgatctaaaagtgctgaaactgaaatggtgccattaaacatacaacaaattctgttcattttcttattcttctatataatgccttactaaataatcaaataagcgtcaccatactcaactgaacaaggaagtcactaagccacaaaaaaatccgtttcagaaacaatccctggaagcctccttggcagaaacagaaggtcgctactgtgtgcagctctcacagattcacgcccagatatccgctctggaagaacagttgcaacagattcgagctgaaaccgagtgccagaatactgaataccaacaactcctggatattaagatccgactggagaatgaaattcaaacctaccgcagcctgctagaaggagagggaaggtaaattataacatgaaaagttatcccagtttcttttattcaatattccagatagcaaggcttatctaaaccccaagaagatgccagagaatgagaggaagggaggagagagggtagagtacagaaaaaggagtacgcaaccgcaatctcactttctcatgaatttggcccaaaatgattcttaagagttctgtgaacttaacattgttttcaaaggatgggttttaaaatatatacctggcagggttttattttttcaacacgttttgcttattttctaaattaacggcaactggaaagctacccaccgttttccaacgttagagataaccgaatgtgacctcaccccgtttagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggctacgggggcggaagctccagcggcggccacggcggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaaggtcagcagaaactagctggggtaatctagaattagttttaacttcctgtgatggtttttttgcgctttaagctctagagttgttttaaaaaattaaaaatcttagagacggttccgtttgcatttgttcacaaactactcttaacaccagccgtgaaaaatggcatgatcaaaatgtcataccttaagcatttttttgggcttaacaatgtaaagttgaaatttccttctttttacaatatttgcttgttaattactaaggatccctacagactgtttaaaattttttttccatcattcacacagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccacaaagtgttctttaatggaaagaaaaacaactttgtgttctcatttactaatgaatttcaataaactttcttactgatgcaaactatcccaatttgtcagaatttatctttacttaagtacataatactctttaaaattaaagattagtaacccatagcagttgaaggttgatgtatccagaaattcggaagacagaactattgtcatgccttttctaagttttttaatcatgtatgttcagaccaccgtcagtaaattcactgagtaaagtctgtaaatccccaatattactctttaagatacacaatatgtggaaggctcccagctctctggctttaaattatttcaatcctggaaattctggaatatctcaaatataacccccaaaataataataa

SEQ ID NO: 3700 - DNA, 1754 bp, Homo sapiens
  Genbank Accession No. X14690
caagaggccaagacgtttgtgaagagcatggaggataaaggaatgaccggcatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcttggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactacgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcattcgcaatgctcagatggacttccaggtggaggtgacaacggagaagatcacctgtggaacaggccgtgcgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccacaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcggcgattttatggcatctggaacatgggcacagagaggggcctgtgggaggggctgggaaaataaagtccaaggtcgagccag

SEQ ID NO: 3701 - DNA, 5722 bp, Homo sapiens
  Genbank Accession No. X14787
ggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaaaagatttaaacaggatggtggctggagccactggtccccgtggtcatcttgttctgtgacatgtggtgatggtgtgatcacaaggatccggctctgcaactctcccagcccccagatgaatgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccgcaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcatcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcaccttgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttccgtaattactaggtagttttctaattctctcttttggaagtatgatttttttaaagtctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattccttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagaatattcagattgtgtagatatgctatttaaataatttatcaggaaatactgcctgtagagttagtatttctatttttatataatgtttgcacactgaattgaagaattgttggttttttcttttttttgttttttttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatattt

SEQ ID NO: 3702 - DNA, 1642 bp, Homo sapiens
  Genbank Accession No. X14813
cggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattt

SEQ ID NO: 3703 - DNA, 1585 bp, Homo sapiens
  Genbank Accession No. X14850
acagcagttacactgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccccagctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggcctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagagccggcggccctgaaggtgagtgaggccctcggcagctgcagccggggtgtctggtacccccccggcgtggtgcttagcccaggactttcagacggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttgcggaacgcgactggcagccaggcctgtcgggcccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgtttttttttt

SEQ ID NO: 3704 - DNA, 144 bp, Homo sapiens
  Genbank Accession No. X15393
cattgtccagctccaagatggtatcccgtaaggctgtggctgctctgctggtggtgcatgtagctgccatgctggcctcccagacggaagccttcgtccccatcttcacctatggcgaactccagaggatgcaggtaaagaacc

SEQ ID NO: 3705 - DNA, 3605 bp, Homo sapiens
  Genbank Accession No. X15422
ggtaaatatgtgttcattaactgagattaaccttccctgagttttctcacaccaaggtgaggaccatgtccctgtttccatcactccctctccttctcctgagtatggtggcagcgtcttactcagaaactgtgacctgtgaggatgcccaaaagacctgccctgcagtgattgcctgtagctctccaggcatcaacggcttcccaggcaaagatgggcgtgatggcaccaagggagaaaagggggaaccaggccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctgaccttctctctgggcaaacaagttgggaacaagttcttcctgaccaatggtgaaataatgacctttgaaaaagtgaaggccttgtgtgtcaagttccaggcctctgtggccacccccaggaatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaaaaatgatcactaacagcaccaacaaagcaataatagtagtagtagtagttagcagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgcttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttctgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactgtagtccagctttgttcttcttcaagtcaagatttccatataaatattagaaacagtttctcaatttctacaaaatcctgatgaggtttctactgggaccacattgagtctatcaatcaacttatgcagaactggcaacttactactgaatctctaatcaatgttcatcatgtatcgcttcatttaactaggatttctctaacttaattgctatgttttgagatttttagtttaaaaaccttgtatatcttgttttggtggttttagtgattttaataatatattttaaatattttttcttttctattgttgtacacagaaatacagttaagttttgtgtgtagtcttacgatgtttagtaacctcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagagcaggtatagactcctgaaagacaatataatgaagtgctccagtcaggcctatctaaactggattcacagctctgtcacttaattgctacatgatctagagccagttactttgtgtttcagccatgtatttgcagctgagagaaaataatcattcttatttcatgaaaattgtggggatgatgaaataagttaacacctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcacaaaaaaaaaaaaaaaaaaaaaaaaaaaaaaaaaaaaa

SEQ ID NO: 3706 - DNA, 414 bp, Homo sapiens
  Genbank Accession No. X15940
ccgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcaaataacgttataaaattgc

SEQ ID NO: 3707 - DNA, 2665 bp, Homo sapiens
  Genbank Accession No. X16260
agtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtcc

SEQ ID NO: 3708 - DNA, 5898 bp, Homo sapiens
  Genbank Accession No. X16323
cacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacataagaaaagaagaaatacaattcacgaattcaaaaaatcagcaaagactaccctaatcaaaatagatccagcactgaagataaaaaccaaaaaagtgaatactgcagaccaatgtgctaatagatgtactaggaataatggacttccattcacttgcaaggcctttgtttttgataaagcgagaaaacaatgcctctggttccccttcaatagcatgtcaagtggagtgaagaaagaatttggccatgaatttgacctctatgaaaacaaagactacattagaaactgcatcatcggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactgtaaatgatactgatgttcctatggaaacaactgaatgcatccaaggtcaaggagaaggctacaggggcactgccaataccatttggaatggaattccatgtcagcgttgggattctcagtatcctcacaagcatgacatgactcctgaaaatttcaagtgcaaggacctacgagaaaattactgccgaaatccagatgggtctgaatcaccctggtgttttaccactgatccaaacatccgagttggttactgctcccaaattccaaactgtgatatgtcaaatggacaagattgttatcgtgggaatggcaaaaattatatgggcaacttatcccaaacaagatctggactaacgtgttcaatgtggaacaagaacatggaagacttacaccgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcctgtaatatcttgcgccaaaacgaaacaactgcgagttgtaaatgggattccaacacgaacaaatgtaggatggatgattagtttgagatacagaaataaacatatctgcggaggatcattgataaaggaaagttgggttcttactgcacgacagtgtttcccttctcgagacttgaaagattatgaggcttggcttggaattcatgatgtccatggaagaggagaggagaaacgcaaacaggttctcaatgtttcccagctggtatatggccctgaaggatcagatctggttttaatgaagcttgccagacctgctgtcctggatgattttgttaatacaattgatttacctaattatggatgcacaattcctgaaaagaccagttgcagtgtttatggctggggctacactggattgatcaactatgatggtctattacgagtggcacatctctatataatgggaaatgagaaatgcagccagcatcaccgagggaaggtgactctgaatgagtctgaaatatgtgctggggctgagaagattggatcaggaccatgtgagggggattatggtggcccacttgtttgtgagcaacataaaatgagaatggttcttggtgtcattgttcccggccgtggatgcgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaattaaaaataccacttacaacaatcctaagacaactactggagagtcatgtttgttaaaattctcattaatgtttatgggtgttttctgttgttttgtttgtcagtgttattttgtcaatgttgaagtgaattaaggtacatgcaagtgtagtaacatatctcctgaagatacttgaatggattaaaaaaacacacaggtataattgctggataaagattttgtggggaaaaaatcaattaatctctctaagctgctttctgaggttggtttcttaataatgagtaaaccataaattaaatgttattttaacctcaccaaaacaatttataccttgtgtccttaaattgtaccctatattaaattatattacatttcatatgctatatgttatagttcattcatttctcttcaccatgtatcctgcaatactggtacacgaacacactttttacaaaaccacatacccatgtacacatgcctaggtacacatgtacatgcactacagtttaaattatgatgtacttaatgtaacctctaaatattttagaagtatgtacctatagttttacctcaaaaaaatagaaatctctaaagaccagtagaaatattaaaaaatgatgcaaaatcaaaatgagtggctaattctccatacgtaatctgcagatgatcttctctggttgacattttacgtgtggccatcaccccgggttaaataacacctaatctaggtgtttacatgtattcaatatcctagtttgtttcatgtagtttctaattcttaaaggaaagagggtaataattctatttgtgtaatttgtttcctccaaacttaaggccacttatttacacaagatatttgtatgtctactttcctaaagcatttcttcagtgctcagatcagtgtctaattgaagaagattaaaactgctttggtcattaaaaacgtatttaaataggttaattctaagacttgctgctgtgattgacttctagctcactgcctttaaattttaaaaaatttaagaggaaaattttcatgtctccaaagttttataaatacccttcatcaagtcatgcattaaagtatatattagagaaaaaaaaatacttttctcaacctggaagattttagcctaataaagtttttttgaagtaaaagaaaacttgtaaagggaaagaaactagtttgtctaaactctgtattcattttttttttttttgaagtacagtggaatctgttgaatcagatattttatcaagatatctttattttttcttatttcatttttacaaagatcactcccaatgccatatgtaatagacatttaaatttcgtgttctgtatgacagccaaatgatcatatttatcattgtatttgtcatgtttagctaaaaatcatgtattgttgagaaatagaataacaaaaagtaataggataggctttgaatttttgcaaaaaatcttcctgtacaaaacatctttaaaaataattttttgagtggtgtgaatctagtattcccatttctctgatttagttttcttgagtgatttttatcaaggctaagtccccaaatgattccctaacagctctttagaataccgtttaatctggactaaaatggttttaagtttatggagagtttagtccacagaactaactggacttctggcggcaagtccagaaatgcttatacaaatttttttttcataataagatatgtgctggtatcaaggaacttaaagtggaagcaaaaagacatccaagtagttgctagtctccatcatcttatctgattgtatttctcttttccttatataatacaccattttcataagaacacctagaaatttcaagagtatattgccaaaatataaagtatatttcctagtttcttctggctgaaccagtgaaattttattgttgcatattaatgatatttttaaaacttttataaaaattgtcatacttttaaatactcacattttaaaaatacttcttttatgactcttcctctaaatttcctggaaatacagataaagattagctagatacaagatgcagctaagtatttagacattttgagcccagtatttttcattttattaaaggctaaaaacaataccaccaataaatcatcaaacaaactgtacaaaataattctgtctttgggaggctccttttgtgatagagggacatgggtggaattgacaatgaaagttagatgaacaaggtccgtgttattttaggtagtagaacagggtagagtcatgtcattatttgcgggcggaagatactatttaccacgtgttctttgctgaatcaattattaaacatttttaaaaatccaattatccactttattttgtgtcattgacaaaaggatcttttaagtcagaggtttcaatgtgatttttggcttggctgtttgaataatggttatgtactgttataattgtagacattttctcatgtctaccaggaattgaagtgtaaaactaaaatatttttcataatgcctctgccgtgcggaaggaatgataatccttttgtatacttctttaattttattgtaaaatgtgtaatgacttttacctatatgctgtgggcaggtcctcagtaaaatctattgagtcaatttctagtattaataggcttttgcttgctatctaagtgtttcaaattatgggaagtgtgagacactggaaggcaagaaaattaacaataatggcatgtgatagcaaaattgtatttcacttattcctgtgaatatttcttgttggtaccaatggtactgtacaaagtgaatgttatagccacaacattctcttgaaaagaacactgtcaagaagtgggaaattgctgtcaggcatttcgttgttgtttttaaactttttaaaaaagaaatactggttttgcaagatagagatcatgaggtaaataattttaataagctcttatactaaaaagccttaaatcgatttactgagattcaaaacatactattataatcaattatatcccatatatgtaggcaaactcatttaaaaaataaaattaattttggtaaaagtacatagtgtttgtttttaaaatacataattttaaaataaatcgcttgtcatgataaagtccaaaaagaagttatctttcaatattcaactaagtttggagctaagaatttactaatacaaaaaaaagttaaaatgttttggaccatatatatcttgacagtgtaacttttaagtaggctcatttccatttgcacagaaagtttctgtctttaggaaactgaaaatgaaatactgtggatgttatgactgtttgtcttctatgtaaataggaaattaataagctgcctattgagtggtatagctgtatgcttacccaaaaaagggaacactgtggttatgacttgtattataaactttctgtagttaataaagttgttatttttataaccatgattatatattattattaataaaatattttatcgaaatgct

SEQ ID NO: 3709 - DNA, 3810 bp, Homo sapiens
  Genbank Accession No. X16349
tctagacctcaggcctgtgaatgcaggctcccccgagtggacagaaatcttggaggacctagatcaggccctagaggaggagaggggagatggaatatcctctcccagttcagaaactttctcggcagtggaggatgatagtggaggggactctgtccttcaccccattgatccccagaggggtgatagctgagtcttgtgactgggcccctgggcaggggtcaagggtcagtgcccctgtttcctttaccccctcctccccgggcaacctttaaccctccaccgcccacacacaaggctgcctgcctctacacattctcccaagagttgtctgagccgccgagtggacagtggctgattatggagagcagaggcccactggctacctcgcgcctgctgctgttgctgctgttgctactactgcgtcacacccgccagggatgggccctgagacctgttctccccacccaggtgcaggagcgggacagggcactcagctcatgcagtcttcccttctctcctctggccctgtagcagggcctctccctctgtctgtctctgacatgtccctactcagctttgtttgttttctctttctgatagagtgcccacgaccctccggctgtccacctcagcaatggcccaggacaagagcctatcgctgtcatgacctttgacctcaccaagatcacaaagtatggggttggcctagcccttgacccagtcccctggttctgccctctctccatcagctcttctcttttccctgtcttcctttccttatctgtgaacaccatctcccccaaacccacactggttctcaaaggacacatgacatacacaatctttccttctgtgtccttccagaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtaagctagctctggtcctcaggggagggatgtctggagctggtctgaggaaagggaacaaaaccaagttattgggcatccctttaccactgtcatctcgtttaatccacacgaacccccacaaagtagctattcttggccccatcttttctgatgggaattcctaaggctcagtcagtatataagtgacaagagctgagtgacccaaggccaaggatgctagctgcttctttaaggcatgttctttccactatagtactaggctgcctcacaggaaggtggcagaaacagatcccaggggcctctgattttgcttcccaccttcctgcaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccggtaactacaccccaggggtggaaccctagccaagacttggtaaagcactgctgggtggctggccgtgggaatctaagtccacacttttagggagaagggaagggttgagagctgcaagggggaggccaaatgctcagaggggagtcaactgagggcagggaggtcgggactgcgcctccgatgccctgatttctacatccccgtatcttatctctgtcacactccagctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgaggtagatttcctcggagtctatttttcccaccctggccagctcagcctgcctctgtccccctctaccactggcccctttcctccttgagaccccagctttgaggcctcaggataatcatttctccccacagacattccccagcctcatgcagagccctgggccttctctttggacctgggactcaagcaggcagcaggctcaggccacctccttgctcttgggacaccagagaacccatcttggctcagtctccacctccaagatcaagtaaagggggacagtggggcattgctgtattcagtggagcctggagcaatgaggaagagggagtccaacatgtcaatattaggaaggtttccagcccagggaacataacaagactggctccacagaattgtttttcattaataattagccaggcatggtggtggtgcttgcctgtaatcccaggtgctggaggccaagaccagaggatcacttgaggccaggagtttgacaccagcctgggcaacatagcagagacctctgtctaaaaaaaaaaaaaaattagccaggcatggtagcacatgtctgctgccctagctatttaggagcctgaggcaggaggttcacttgagcccaggagtttgaagctgcagtgagctatgatgtgccactgcactctgacctgggccacagtgagaccctgtctcaaaaaaataaaaataaaaataaggcttatggatggcactcaggtgggtggtaggggcgagggacatatcttgaagctccccacagcaagcaaacagttttgacttagactgcatatttacttggggcaggtgtggtttcaaaaagggtcagccaaaaaaaattggggcaggatttaagtggtgagaatggccagtaggtggaggcatagcgaagaggcagaattaaggcagctaggggtgaggccacagcgagtaggcccggctcattcttccctctctctctaccgtccctttcccacacactctgcagaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggtaagagagaatgatgttcaagttcatgagcacaacattggaaacagctcaagggaggcggcacattttgaggggaaggaaacctctgggagggaagaagaataggccacaagaagaagatatgggggcagtggaaggtagtgcttttgcaaactcaggttggaggagtggaaaagtggggagaagattctggatccgagccaccttaatgctctaatgccacctttgcactacctccctctaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagttactgattattcatttaattcaacaaatattcactgtgcactagcaatgtaccaggcactgtgccaagtattgagttgtcttaatgagcaaaaacactctggttcctaccctcttggtgcccacgtcccatagggaagcagacattccatcaaaggctaactaataagtggatagttggaagcactgataaagaagaattggagagttgtgaaaacatggagactggccgggcgtggtggc

SEQ ID NO: 3710 - DNA, 5527 bp, Homo sapiens
  Genbank Accession No. X16416
cgcggccgccctgggcgggcgcgggcggcgggcggcggtgagggcggcctgcggggcggcgcccgggggccgggccgagccgggcctgagccgggcccggaccgagctgggagaggggctccggcccgatcgttcgcttggcgcaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctgaaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccactgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccggcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccatgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgccatttcgggaagggcatgcacgggccatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctcgcgacaggtgggaggaaagggcctgcgcagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagataccggcgggctgtgactctgggcagggacccggggtctcctggaccttgacagagcagctaactccgagagcagtgggcaggtggccgcccctgaggcttcacgccggagaagccaccttcccgccccttcataccgcctcgtgccagcagcctcgcacaggccctagctttacgctcatcacctaaacttgtactttatttttctgatagaaatggtttcctctggatcgttttatgcggttcttacagcacatcacctctttccccccgacggctgtgacgcagcggagaggcactagtcaccgacagcggccttgaagacagagcaaagcccccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccctcgggggcctgtggtggctccccctctgcttctcggggtccagtgcattttgtttctgtatatgattctctgtggttttttttgaatccaaatctgtcctctgtagtattttttaaataaatcagtgtttacattag

SEQ ID NO: 3711 - DNA, 1968 bp, Homo sapiens
  Genbank Accession No. X16663
aattccgccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcatacatctcagaaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgctccaccccctccctattcctgatgcaaatgtctaaccagatgagtttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 3712 - DNA, 1807 bp, Homo sapiens
  Genbank Accession No. X17025
tctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatgtgcttaacaaacttagaatgactttttccttttaaatttagttctatcattaatttatcattaaatttagttctatcatttggtactatcattaatgtattataaaacttgtgtggaaaaaactaacttataattttgtatcacacaccctggatatgtgttctgtttctaagcgacatttgtgagagattattgtaaaatgagagcgagaaataaaacttaatttaatctttgcagatacatacttatgggaaatttgaacaaatgagtgaaactctgtttttagtaggccgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaaggttcaaattaaatgatatgaccctaatttgtatcattctgagttgattgtgtggtttattcattctgaaacatgttgatacttacagtcaccgactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctagggacagagtcaacccccaactgaggaccactgtctacagagtcaggaaatattgtagggagaaaaaaataacaacaacaaaggcctatattaatgttaaatagaggagattatggaatgtgtatattaatgttaaaaattattccttattcaatgtatttttatcaaatcgatagatatctcagatttgaaactcaagacag

SEQ ID NO: 3713 - DNA, 4316 bp, Homo sapiens
  Genbank Accession No. X17093
ctgcagctaataaaaaaaaaaaaagaaagaaagaaactggtctctgtcctatttcatatgctcaggtacaacttttccagagaagaagaggaggggggcggggaggagcaggaggaggaggaaagaaggaggagaaggagaaggagaagaagaggaagaggaagaggaagaagaagaagaagaagaagaggaagaggaagaggaagaagaagaagaagaagaagaagaagaagaagaagaagaagaagaagaagaagaagaagaagaagaggaagaagaggaagaagaagaaactgtctctagaccttcattctcaggacaagttcattgtctggcaccaagctccttggggtgaattttcttccaaaagagtccggggagtccaggtatggaatgggaggcagaaagttcaatcaagggactgggatttcggaatgaataatgaagggagatggactgggtccatgccgaaggtttctccctggtttctcagcccccgggcgaagactcagggagacattgagacacaccctgcacaggagggggagggggagggggagggcaaagtcccagggccccaggagtggctctcaagggctcaggccccgaggcggtgtctggggttggaaggctcagtattgagaattccccatctccccagagtttctctttctctcccaacccgtgtcaggtccttcatcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggtgagtgcggggtccagagagaaacggcctctgtggggaggagtgaggggcccgcccggtgggggcgcaggactcagggagccgcgcccggaggagggtctggcgggtctcaccccctcctcgcccccaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctggtgagtgaacccggccgggggcgcaggtcacgaccaccccccatccgccacggaccgcccgggtccccccgagtctccggatccgaaatctaccccgaggcagcggacccgcccagaccctccacccgggagagtcccaggcgcctttaccgaggttcattttcagtttaggccaaaatccccgcgggttgggcggggagggggcggggctagctgggcggggctgactgcggggaccggctagggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcaggtaccaggggccatgggcgccttccctatctcctgtagatctcttgggatggcctcgcacaaggttgggaggaaagtgggcccaatgctaggatatcgccctccctctagtcctgagtaggaagaatcttcctggctttcgagatccggtaccagagagtgactgtgagagtccgccctgctctctgggacaattaagggatgaaatctctgagggaatggagggaagacagtccctggaataccgatccgcggtcccctttgagccctccaacagccttgggccccgtgacttttctctcaagttttgttctctgcctcacactcaatgtgtttggggctctgattccagtccctcggcctccacttaggtcagggccagaagtccctgctccccactcagagactcgaactttccaaggaataggagattttcccaggtgtctgtgtccaggctggtgtctgggttctgtgctcccttccccaccccaggtgtcctgtccattctcaggttggtcacatgggtgctgctggggtttcccatgaggagtgcaaagtgcctgaattttctgactcttctcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatggggtaaggagggagatgggtaaagaggggaacgaggggtcatgtcttttctcagggaaagcaggagcccttctggagctcttcagcagggtcagggctgaggcctggagatcagggcccctcaccttcccttcctttcccagagcagtctccccagcccaccatccccatcgtgggcatcgttgctggccttgttgtccttggagctgtggtcactggagctgtggtcgctgctgtgatgtggaggaagaagagctcaggtaggaaggggtgaggagtggagtctgagttttcttgtcccactgggggttgcaagccccaagtagaagtgtgccctgcctcattactgggaagcaccatccacactcatgggtctacccagcctgggccctgtgtgccagcacctactcatttgtaaagctcctgtgaaaatgaaggacagattcttcacttcgatgattatggtggtgatgggacctgatcccagcagtcacaaatcacaggggaaggtccctgctgatgacagacctcaggagggcagttggtccaggacccacatctgctttcttcatatttcttgatcctgccctggatctacagttacacttttctggaaacttctctgggatcaaagactaggggtttgctctaggaccttatggccctgcctcctttctggcctctcacaggacattttcttcccatagatagaaacagagggagctactctcaggctgcaggtaagatgaaggaggctgatccctgagattgttgggatattgtggtcaggagcctatgagggagctcacccaccccacagttcctctagccacatctgtgggctctgaccaggtcctgtttttgttctaccccaatcactgacagtgcccagggctctggggtgtctctcacagctaataaaggtgacactccagggcaggggccctgatgtgagtggggtgttgggggggaacagaggggactcagctgtgctattgggtttctttgacttggatgtcttgagcatgaaatgggctatttagagtgttacctctcactgtgactgatacgaatttgttcatgaatattttctctatagtgtgagacagcttccttgtgtgggactgagaagcaagatatcaatgtagcagaattgcacttgtgcctcacgaacatacataaattttaaaaataaagaataaaaatatatctttttatagatacaggtagatatgtttttatagcatgcacgtaaatgtgtgtgtgtgtgtgtgtgtgtgaagagaaagagtgaatagagagattaagattcttttaatggtgaaaagatatacatatatttggaattagccagcttgactcagtttaggtgatcccaattttggtggcaacaaccaaagcatcgtagtcaggagccagtcgaacatatgccttcctctctccatcagactgaatcagagtgttgactttggccacatcaatgtcacaaacttcttcacagcctgtttgatctggtgcttgttggctttaacatccacagtgaacacaagtaggctgttgttttctatcttcttcacagcctactcagtggtcagcggaaacttgatgataacatggtggtcaagctt

SEQ ID NO: 3714 - DNA, 4180 bp, Homo sapiens
  Genbank Accession No. X17094
gcggggaagcagcagcggccaggatgaatcccaggtgctctggagctggatggtgaaggtcggcactcttcaccctcccgagccctgcccgtctcggccccatgcccccaccagtcagccccgggccacaggcagtgagcaggcacctgggagccgaggccctatgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 3715 - DNA, 934 bp, Homo sapiens
  Genbank Accession No. X17206
ggcatccacttcttttccgacaaaacaccaaatggcggatgacgccggtgcagcgggggggcccggaggctggtggccctgggatggggaaccgcggtggcttccgcgaggtttcggcagtggcattcggggccggggtcgcggcgtggacggggccggggcgaggcgcggagctcgcgaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccctgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaa

SEQ ID NO: 3716 - DNA, 1044 bp, Homo sapiens
  Genbank Accession No. X17567
gaattccctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgc

SEQ ID NO: 3717 - DNA, 3075 bp, Homo sapiens
  Genbank Accession No. X51466
atggttaattttacggtggatcagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcatatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcactcagctgtactagtgccattggaataataaatttgataaggtgtgaaaa

SEQ ID NO: 3718 - DNA, 3044 bp, Homo sapiens
  Genbank Accession No. X51521
  unsure (1)..(3044): n = a or c or g or t
aggcagggcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacacagccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctcgtgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgatttttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatatttttttagttcttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggnagtggtggagctggacctgcctgctgcagctgcagtcacgtgtaaacaggattattattagtgttttatgcatgtaatggactatgcacacttttaattttgtcagattcacacatgccactatgagctttcagactccagctgtgaagagactctgtctgcttgtgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggca

SEQ ID NO: 3719 - DNA, 3637 bp, Homo sapiens
  Genbank Accession No. X52150
agccgctcctcctctgagaagctccggacccgagaggacaccgacactgcgcagcgccgagcccgcgcgcagcccggacgcctcagccagggccgaccgcgcagaggaagctcccagagcccgtttcaagaccgcagccaacagcctcaggcgcacacggcggcctcggagcgagcacgcgcagcaacgcccctcgccccggcccgcccccggccccgccccgcaagggtcacaggtcacggggcggggccgaggcggaagcgcccgcagcccggtaccggctcctcctgggctccctctagcgccttccccccggcccgactgcctggtcagcgccaagtgacttacgcccccgaccctgagcccggaccgctaggcgaggaggatcagatctccgctcgagaatctgaaggtgccctggtcctggaggagttccgtcccagccctgcggtctcccggtactgctcgccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctaggtaaagagggggccgcgcctcttccccgccccgaccctccatccctttcctcccaatggattgcaggggggcgggaaaaacgtctgtctctctctctagggaaggccacatttctgtctgtctcagggactctgtgacttgtcccgcagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccaggtaggaaccacccgggccctcagccaccctcccacctcccaaagtcccccagccccttgactgtcccgcagccccacctgccagcccagccctcacggcagctgcccgcctcagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcacgtaagtgatcttggcccaaccccctggctgcccgttgacccctacccagtgctaactccagtctttgcccccagcacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatgggtatgccagcagggcagctgggtgctccggccctgtcacgggccagggcctggaggccttgcagttcagctgcttgccaagaacatagtgggtgagggggtgccaggagatgctggccacgttgcaggggcccaaggtgtagtcaggagacacaggtgcacagagagctggtcttggtaggcctgggaggtgccgggctcatgctgggcacctccgggcaagctttgtgacttagaggtgtggggccactggtcaccctcggtggctcagaggctgtggctccatggctcatgagcgcctcctgtgtcccagacctgagaccatgcgtatgtcccgaggcggctgctccggtctcttgcggtgtggaaagggaacgacctacgagggcggtgtccgagagcctgccttggccttctggccaggtcatatcgctcccggtcagtccgcaggccctctccttggaaccctggccccaccaccccaaccttgatggcgaactgagtgactgaccagcctcctgcccccaggcgtgacccacgagctggccagctccctggacctgctgcctaccctggcagccctggctggggccccactgcccaatgtcaccttggatggctttgacctcagccccctgctgctgggcacaggcaaggtagggccggtgacccctgatcccagatccttggcccctgtcctggccttcccctggggtgagtgtggcagtgctgagagtctgtgcctcagtgcctcctgcactgagtggcatccaagtggcgccacctctcaggttcctgggtgggcaagaagcggtgcacgtccagggcctcccaccagggctggcagcccaggtatgtgcagtgcttgggcctgccccgccccgtgacccctgactctgcccccagagccctcggcagtctctcttcttctacccgtcctacccagacgaggtccgtggggtttttgctgtgcggactggaaagtacaaggctcacttcttcacccagggtaacccctccccgtggatccctccccccgaacctgctgacccctccccggagccctagatccctggcccctcctctcgcccttgccctgtgcacagaattggccccctccccaggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagttgtgggggaggctcaggtgtctggagggggtttgtgcctgataacgtaataacaccagtggagacttgcagctgtgacaattcgaccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgctccttggtgatctgcgtgggtctgtgcacacaggcacacgtcagccacaaggcacatggacgagcgcacgtgcttgagtgcaggac

SEQ ID NO: 3720 - DNA, 2754 bp, Homo sapiens
  Genbank Accession No. X52520
attgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggggaccctactgtgtttggaaacctgcctacagaccctgaagttacccaggcaatgaaagatgccctggactcgggcaaatataatggctatgccccatccatcggcttcctatccagtcgggaggagattgcttcttattaccactgtcctgaggcacccctagaagctaaggacgtcattctgacaagtggctgcagccaagctattgacctttgtttagctgtgttggccaacccagggcagaacatcctggttccaagacctggtttctctctctacaagactctggctgagtctatgggaattgaggtcaaactctacaatttgttgccagagaaatcttgggaaattgacctgaaacaactggaatatctaattgatgaaaagacagcttgtctcattgtcaataatccatcaaacccctgtgggtcagtgttcagcaaacgtcatcttcagaagattctggcagtggctgcacggcagtgtgtccccatcttagctgatgagatctatggagacatggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgagatccgagatgggctggtgaagctgagtcagcgcattttgggaccctgtaccattgtccagggagctctgaaaagcatcctatgtcgcaccccgggagagttttaccacaacactctgagcttcctcaagtccaatgctgatctctgttatggggcgttggctgccatccctggactccggccagtccgcccttctggggctatgtacctcatggttggaattgagatggaacatttcccagaatttgagaacgatgtggagttcacggagcggttagttgctgagcagtctgtccactgcctcccagcaacgtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattactcccttgctctgcgctgctagagtgactcactaattcattaatctgcctccctctcgtaagatttccttcttttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttggatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgcaagggcataaattattgtttttctttttttttttttaataaatttcaccaagt

SEQ ID NO: 3721 - DNA, 3132 bp, Homo sapiens
  Genbank Accession No. X52541
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaacggtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtatcccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaaaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttcttttttttttttgaaagtgttttttcttcgtccttttggtttaaaaagtttcacgtcttggtgccttttgtgtgatgccccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 3722 - DNA, 6711 bp, Homo sapiens
  Genbank Accession No. X52851
gaattcccttgtaaggttttcttaacaaaacaccagtcacataagtgcattttattttatatttttgtttatttatttgagacggagtctcttgtctctcaggctggagtgcagtggcgccatctctgctcgctgcaacctccacctcctgggttccagcgattctcctgcctcagcctcccgagggggtagctgggactacaggtgcgcaccaccatgcccagctaattttgtatttttcgtagagatggggtttcaccatgttgtccaggctggtcttgaactcctgacctcaggtgatcctcccgcctcggcctcccaaagtgctggaattacaggcgtgatccaccgcacccggcctattttttgagagagggtcacactctgtcgtcccggctggaatgcagtgatgcgatcaccgcccactacagcctcgacctccgggctcaagcaatcctccccgcccagcctcctgagtagcgagcgcctcgacgcccagctaatttttatttttatttatttttttgtagagacggcgtctctctaagatgcccaggctggtggccggtgtcgaactcctaagatgaagcgatcctccccggccttggcctccgcgcctcctaaagcgccaggtatgagccaccgcgcctggcctacaagtgcattttaattaaagtattattaatgtctttgcctgaagaaattcgcttttaaattgtgacttatctttcacccaaaaatcaaagcacaattcagccccgaggcgggggcggtaggagctgggcggggcgggggcagggaaagaccaggagcagagattcaaaaagagtaagagggcaaaatgtgcataatgcatcttcacaggtaagagcctggccaggctcctgttttaatggcttcctcctgaagaagattcaagcagagtgtaagatattttcggaaagtagagcattttgaaagcatttcataatctctcaaaaccggagactgctcctgtcccacctcgttagagaaaacagcgatgctcaaaggcaacctccttcctgacattgcctggtaggacgcgacgtggtgtttgcccgcgcggaatgcggacgcaaggctgctcctaggtctcggggacgcgccatccccatttccgctcgcggaggcgtagggtccgggcgcgggaccccagtcgaccttgactggcggcgcgaccttgaggcctgcgttcgcctcagttgccccctctgtgcaatggggagacgcgcctcatcgcttgacaacggccgaagagccgccgcgcttccgtctcccgcgtgcgcgcgccatgctgcccacccccgttccgcactgaccctcccccgtgccccgcgtcccgtactgccgccccgccccgagtcccatgccgcagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaacgggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtcgggcgggcggcggcgtgcgggaatggggcccagaaagtgggccggggtcggggtgggtggtagcgccccaaaggcccgggcgcggggcgaccctgcttgaggggcgagcgcgggcgggctgcggcgccatttcctgacgaggggccattttgggaggtccgcgagtcgcgggaggaggccgggacgcggcggacaaaggcaggcggggcggctgcgaggccgttgggggagggggcccgcgtccgcccgcccgcctcatgtggccgcgccctgtcctgtccgacgcacgtgctcggcggccgcgctcaggtccgcgccttgagagtcgttgtccgccctagcttggcctgggcgccgcagaccggagccagaagcacgctcgcgggggcttgcgaccgccttcctgggaagctgtcccctggcaggcatgggtgctttacatcctgagctgggaagctgtttgcttgagggtttttctcaaggatcgaggcgcggtgtgagcccgtccatgctcggtcctgtagatcccgggaggccatgttataaaaggagacttgctgggatgtgacgggttgccacttgaaatatcttccatttggataaagtaggaatatttatacatgtgccccaaacgtccctccgtgtcccccacccccaagcggaaatgtgaaaatgggccttgcctttgctggtgcccaaggaccgccttccactgcagtgacggcgctggcgggggaggcgctcttgagcccctcccgattgtccctctgcctagcaagcaagttgcgactggccacaaggcaggcctcttccgaccaaggtggattaccagtgattacctaattagttttgagagcgttaaatgagttcttaaagatcagttgtaattatagcatagtatctaaacttggcgcgtgtcttcaaagttaaatattgagtacgattccgttccagttaacatggatagaccttagggagtagcgaaataggatgttagtggttttattcctttaaatcacatctcaaaaggccaccaatggctagtttggatcttattccgaaaatagattgatcctcatgcagtcttcgtgaggacagagcgatttccttgttgcctaccctgtccatagtgcctggcacataggcactgaaacactgcatgttaatccacaccccaccccacctatgagtgtagtcaaagctggtaagtgacaagggctttcgtggaaacttggcctgacctaatgttgggcatcaggttacccaaagagcttcagggaaatgagaaaggacttgcaggtcttgatgagaatggaggggtaactgccaatgagggctttggctttagcgaaagtctgaaagggaagccataggaacttaaacgtaccgactataaagctctgagaaaagctgatgttttagaaagaccatacattctaggtacaaatacctaaaaactaaaaaataagtacgttggccaggcgggcggatcacgaagtcaggagattgagaccatcctgggcccctggtgaaaccccacctctattaaaaatacaaaaattagctgggcgtggtggcgcttgcctgtaatctcagctactctagaggctgaggcaggagatcgcttgaaccccggaggcggaggctgcagtgagccgagatcgtgccactgcactccagcctggtgacagcgagactcttgtctcaaaaaaaaaaaagtacattgctataagagaagtgcacacggatactagtagttaattcagtcacatctgtgaaatagcttataaaatgctacttttaaacaagctgtttttatgaaagggcttgtaaatgtttatggtatttaagctacctctctagccataacgtattatacattcaagaaaggttcaaaaccagatatactagaaaccaatctttattttttaccccactactaggtaagggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttgtaagttctagctcaagttggggggtggtgatagacatttaagaagccatatatcttttcagaagtaggtgtgatgtactaaaagtttgagacactttctagaagtctcactatttaagttatgactagtattggatttttggcatgtctttgggtttcatgtttcttaacccaactgcctgcagggccttatggctgtcaggagcagttcttgggaattaaagtaattactgaagaagtattctagtgagaaaatgaatttatgactcagaagcccctaaagacatgggtactaagcaacaaaataagcagatgttaattaactgtaattttctcttacagctgtttgcagacaaggtcccaaagacagcaggttggtccattttctaagtttaacaaagatgttccaattgtgacagtttgtgtgtgtgtgtgtatatatatatttttatgtatgtatatatgtgtttaatttttttttaaacagaaaattttcgtgctctgagcactggagagaaaggatttggttataagggttcctgctttcacagaattattccagggtttatgtgtcaggtacgaaatttactgaattttattttatttgggttgctcccttcatttgggattgagccagaatatttcaggatacacatatctgaactgttactctaccatttcggttctatttaacccttctattcagtttgaacttgggtttaaagtttgaaccttgcagatttggcacacttcatggttatgttgtcagaagtgacatttttcctatatgttgacagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggtaagggtacaacatggcacactaaccacctgactaaatgaaaagttgccctggggggaacggaacaaacactacttttcttcaacctttgcttccacagactttttcatccctaagatactagaagaagagcatacataaatgacaaatatagccaatgtgatacagaatgtcagatactatgatagaaacttggcccttagctgggtggttgaattaggtgctacttttttgagatggagttttgctctgttgccaggttggagtgcagtggcacaatctgggctcactgcaacctctgcctcctgggttcaagcgattctcctgccttggcctcctgagtagctgagaatacagatgtgtgccagcatgcctggctaattttttgtatttttgtggagacggggtttcatcatgttggccaagctggtcttgaactcgtgacttaaggtgaaccacctgccttggccccccaaagtgctgggatttcaggcatgagccactgcgcccaaccaattaagtgcttttttttttttttttcttttctcagactggatctcgctcttatctcccaggttggagtgcagtggtgccatctcagctcactgcaacctcctcccgggttcaagcaattcttctgcctcagcctctcaagtagctggaactacaggcatgcaccaccactcccagctaaattgtgtattattagtagagcgggatttaccatgttgtccaggctggtctcgaactcctgggctcaagtgatctgcctgccttgacccccccgaagtgctgggattacaggcatgagccactgtgcccacccaattaagtgctgcttttatgttactattaataacatgcggttggttgggttttttgtttctttggggtttttgttttgttttgtttgtttttgggggaggggggcgcaattcattctatatgtgtaactcttttttgagatggagtttcgctctgtcgcccaggctggagtgcagtggcgcgatctcggctcactgcaagctccgcctcccaggttcacgccattctcctgcctcagcctcccgagtagctgggactataggcacatgccaccatgcccggctaattttttgtatttttagtagagacagggtttcaccgtgttagccaggatggtctcgatctcctgacctcgtgatccgcccgccttggcctcccaaagtgctgggattacaggcgtgagccaccgcacccggcctatatgtgtaactctttaatggtaattggagaatcatgtttaatgacatttagtacaaaaggcttcagttaaaaaaaaaaaaaaaaagctacctttctcgtcttggttcatgacacatggaggctgcttgtttgtggttgccagtcataatgattgttcttccttttcaaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatatt

SEQ ID NO: 3723 - DNA, 430 bp, Homo sapiens
  Genbank Accession No. X52966
cttctcttaccgccatcttggctcctgtggaggcctgctggaacggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcttgccaaattccgaagcaatcttcctgctaaggccattggacacagaatccgagtgatgctgtacccctcaaggatttaaactaacgaaaaatcaataaataattgtggatttgt

SEQ ID NO: 3724 - DNA, 603 bp, Homo sapiens
  Genbank Accession No. X53331
cgtgctgctacacaagaaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggggccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactt

SEQ ID NO: 3725 - DNA, 1600 bp, Homo sapiens
  Genbank Accession No. X53414
ccggaagcccatccaccaatcctcacctctcacctctgtgtccgccctgctgggaaatattccaggctttggccaaggccagtgcagccccaggttcccgagcggcaggttgggtgcggaccatggcctctcacaagctgctggtgaccccccccaaggccctgctcaagcccctctccatccccaaccagctcctgctggggcctggtccttccaacctgcctcctcgcatcatggcagccggggggctgcagatgatcgggtccatgagcaaggatatgtaccagatcatggacgagatcaaggaaggcatccagtacgtgttccagaccaggaacccactcacactggtcatctctggctcgggacactgtgccctggaggccgccctggtcaatgtgctggagcctggggactccttcctggttggggccaatggcatttgggggcagcgagccgtggacatcggggagcgcataggagcccgagtgcacccgatgaccaaggaccctggaggccactacacactgcaggaggtggaggagggcctggcccagcacaagccagtgctgctgttcttaacccacggggagtcgtccaccggcgtgctgcagccccttgatggcttcggggaactctgccacaggtacaagtgcctgctcctggtggattcggtggcatccctgggcgggacccccctttacatggaccggcaaggcatcgacatcctgtactcgggctcccagaaggccctgaacgcccctccagggacctcgctcatctccttcagtgacaaggccaaaaagaagatgtactcccgcaagacgaagcccttctccttctacctggacatcaagtggctggccaacttctggggctgtgacgaccagcccaggatgtaccatcacacaatccccgtcatcagcctgtacagcctgagagagagcctggccctcattgcggaacagggcctggagaacagctggcgccagcaccgcgaggccgcggcgtatctgcatgggcgcctgcaggcactggggctgcagctcttcgtgaaggacccggcgctccggcttcccacagtcaccactgtggctgtacccgctggctatgactggagagacatcgtcagctacgtcatagaccacttcgacattgagatcatgggtggccttgggccctccacggggaaggtgctgcggatcggcctgctgggctgcaatgccacccgcgagaatgtggaccgcgtgacggaggccctgagggcggccctgcagcactgccccaagaagaagctgtgacctgcccactggcacacagctggcactggcacacacctgtcccatgcccaccctgagggatcaggagcaaacagaccctgcaaggtcctccaggcctggggacaggaaagccactgacccagcccgggaggcagaaccaggcagcctccctggccccaggcagcccttttccctccagtggcacctcctggaaacagtccacttgggcgcaaaacccagtgccttccaaatgagctgcagtccccaggccatgagcctcccgggaatgtttaataaagggcctggccacctctcctcac

SEQ ID NO: 3726 - DNA, 1170 bp, Homo sapiens
  Genbank Accession No. X53595
ccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaattacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgc

SEQ ID NO: 3727 - DNA, 4615 bp, Homo sapiens
  Genbank Accession No. X54380
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggcgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggtcagtgtgcagctgaaagcctctccagccttcctagcttcccaaaatacaaagggagaagaatcctattgtatctgtggaagtgagagacaaaccttgtcttggacagtgactcctaaaactctggggaatgtgaacttctcagtgagtgcagaggcaatgcagtccttagaactctgtggaaatgaggttgttgaggtccctgagattaaaagaaaagacacagtcatcaaaaccctgttggtggaggctgaaggtattgagcaagaaaagactttcagttccatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccagacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaactaaaaaa

SEQ ID NO: 3728 - DNA, 736 bp, Homo sapiens
  Genbank Accession No. X54667
ggctctcaccctcctctcctgcagctccagctctgtgctctgcctctgaggagaccatggcccggcctctgtgtaccctgctactcctgatggctaccctggctggggctctggcctcgagctccaaggaggagaataggataatcccaggtggcatctatgatgcagacctcaatgatgagtgggtacagcgtgcccttcacttcgccatcagcgagtacaacaaggccaccgaagatgagtactacagacgcccgctgcaggtgctgcgagccagggagcagacctttgggggggtgaattacttcttcgacgtagaggtgggccgcaccatatgtaccaagtcccagcccaacttggacacctgtgccttccatgaacagccagaactgcagaagaaacagttatgctctttcgagatctacgaagttccctgggaggacagaatgtccctggtgaattccaggtgtcaagaagcctaggggtctgtgccaggccagtcacaccgaccaccacccactcccaccccctgtagtgctcccacccctggactggtggcccccaccctgcgggaggcctccccatgtgcctgtgccaagagacagacagagaaggctgcaggagtcctttgttgctcagcagggcgctctgccctccctccttccttcttgcttctaatagacctggtacatggtacacacacccccacctcctgcaattaaacagtagcatcgcc

SEQ ID NO: 3729 - DNA, 717 bp, Homo sapiens
  Genbank Accession No. X54941
agagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttctgccgggtgttgtatgtgtggtgacttgcggatttatgtttcagtgtactggaaactttccattttattcaagaaatctgttcatgttaaaagccttgattaaagaggaagtttttataat

SEQ ID NO: 3730 - DNA, 627 bp, Homo sapiens
  Genbank Accession No. X54942
agtctccggcgagttgttgcctgggctggacgtggttttgtctgctgcgcccgctcttcgcgctctcgtttcattttctgcagcgcgccacgaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttaaaaaaaaaaaaaaa

SEQ ID NO: 3731 - DNA, 1300 bp, Homo sapiens
  Genbank Accession No. X55283
ctgcactctcctctcccctgtgagctccacctgccccagttctcctggctttaacccctccttggccaaggccagggttgcctgcgggagccaggcgtccgctctccacacctttcacagccccagccctcagagcaacctcagcccagcccagcccagctccagctccagctccagcccgggccccatcatggccaaggactttcaagatatccagcagctgagctcggaggaaaatgaccatcctttccatcaagggccacctcctgcccagcccctggcacagcgtctctgctccatggtctgcttcagtctgcttgccctgagcttcaacatcctgctgctggtggtcatctgtgtgactgggtcccaaagtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgctt

SEQ ID NO: 3732 - DNA, 833 bp, Homo sapiens
  Genbank Accession No. X55715
cgttgctgtcggcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtgtctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagtggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacctaaagatgagatactgcccaccacccccatctcagaacagaagggtgggaagccagagctgcctgccatgccccagccagtccccacagcataacagggtctccttggcagctgcattctggagtctggatgttgctctctaaagaactttaataaaattttgtacaaaagac

SEQ ID NO: 3733 - DNA, 479 bp, Homo sapiens
  Genbank Accession No. X55954
ccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccatt

SEQ ID NO: 3734 - DNA, 515 bp, Homo sapiens
  Genbank Accession No. X56411
aaagcttgctagattaactattgatacacaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatggggttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagtaagcaagtaagctgtatc

SEQ ID NO: 3735 - DNA, 10368 bp, Homo sapiens
  Genbank Accession No. X56494
ggtcttcacattttgaatgcgcaacattgtatctgtgaatgaaggcaagagttaacagctgtttaattgataactgctcgcatcattagttgctggctaacaactgggaaatcagaaaatgtcttgtagaaaaatgtaagaaaagttccaacaatactgacttaaacacgagcaaaggtgaaaacagaaatgctgactcctgcataggttatcggccctaatgttctgacttgatatttccagatgcccagctctgcgctaatatcaacaccgtctatttactttctactctgaggcattcgctctgcaggattccagaccctactaaattattcacatggccccaaccggtccttccttgttccgcggtcctaacacaatgaatggtcctaagaggaaaacggcctcggctcccgctccaggcccacttcgcagtccctagttctccctactgccgctccagtgccagagcccctccgaaggcggccaggacctccaaccacgcacaagtctgcagctctccccaactttccgttcagctcagtctccgagggtgcgccagagcagacacccggaggagtggggagtggcagggcggggccgggagaatgctgccccggaacccataaattcggccctgcccaggtaggccgggacagctggggtggcctgggccgagagccaagaaaagagaccccatctggacgcccaacttggcggcaacaggtggccggcgcccgggggtctgggaggaaagtcgctccgggcgggccccgttgccccgccgcgtccccattggtcatcaggtttcttaaaatgtgactctgaatctgtgtccttccgccgcagaatttagtcccaccgaaagggcaacctgcccgcgcgttccgccaccgccgccgcgcttcctcctgaaggtgactcgagcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcagccggaggtgagcggtgcaggcagtacgccatcagtccccaccaagggccagtcgcccggctagtgcggaatcccggcgcgccggccggccccgggcacgcaggcagggcggcgcaggatccctgtgctaaatggtatattaaccacttctcagtcttaccactctctttcaatttgtctcgacccaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggtgagtgggtgtcccccttcccccaaaaagggcttcatgggcagtgacctttctctcctgaaaagagctccatgcactttttaaagacttttgagctatttgggagaggaaaaattttcagggaaaaaaattctttaaacttaaagcaaacttaaatgtttttccttggttgaataattaatacttgtggctttaaaacttttcctaataggcccagcttcccgatcagtggagacgttgaaggagatgattaagtctggaatgaatgtggctcgtctgaacttctctcatggaactcatgaggtgagctgtggctggaccctatcctggcaggggaattggagctggattctagtgtgggagcacgcttgtcatcttccttcttttcccccagtaccatgcggagaccatcaagaatgtgcgcacagccacggaaagctttgcttctgaccccatcctctaccggcccgttgctgtggctctagacactaaaggacctgagatccgaactgggctcatcaagggcgtgagtattctgcggagagcgaggggaaggctcagtaggcaatatgccccagagacatgattccttccgaggtgatgctgctactggtgtctccagtttggactcttccttactctcttgtccctagagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtacgtatgggagctggagtccagttgtctaaaacagtcttttgtctctaaacttctcgtctctgcctccccaacttacccttttttatacaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggcaagtccccgttgtccctggtctactgccatacttgtggcctctgttctatataacctctctcccccccactttgtccatcaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcaggcatgtgcccacccttccccacattctcatgtgcacactcgcatgtttgtatgggaaagctctggaggctgtctgatctcttcccatggaattgtcgcaacgtaacacacagataatccccttcccccatgtacctacacaaagccatactctgtgtacctactcactatccagaggatcagcttgctgtcatttgtctctgaagacagctcaagctacatctcactaatgctctgtcccctcccagatgctggagagcatgatcaagaagcccccgcccactcgggctgaaggcagtgatgtggccaatgcagtcctggatggagccgactgcatcatgctgtctggagaaacagccaaaggggactatcctctggaggctgtgcgcatgcagcacctggtgagttctgggcctgccccatcccccagggcttcggactgggcctgggatggatgcaagctctggtgcagagctttttaggtttctccatcctcttatgcacagcctttcattatcctccaagttacagcagcaagagggtgggggtggaagtggaggtggctttttttttttctcctgttcctgcattcctgcccacacccccacccctctcatttccttctgctctggaggcacctccttcattggacaccacacagtttatttcacttctgacttcaaggttgtgaattcttcccatggcttaagtcctgggatacttctgcagtgaaaggaggtcttgtacctcttcctcagagtcagaagttctgagtacctttgccctattctgaaaagggctaggggctcctgctcccagctgccctcttcctttggcttccaattcagttccctctgccccgcatcctgcagacaggcgctcccgcagggggcccttgtggacctgcactggagtctgttgccttcactgagctgcctgtgctggccttgcatggtgcctgtagggggatttgctttgctgtgccattggggtacagctgctgctcttactctagaccaaaaagtcgggttgagtgactggtggcagggccaagatagagacagcggggagggtggctgaccctggcggccctggactgagcgtctggaggagtcgtggaggctctttcccttctttctcctctgagagctcgttcttcaggctcttccagcttgtcatgtcgagtgcctggccactgctcagggttggaggctcagtccctttgccctgtctgttccagctctggagctaactcagggatccctgatcagggttacgtaggtttggtaaaatgagtgctggaaattaactttctcccagtagtcttaggtctagctcagtgaacttaaactttatccagatatggtttttccttcagcctttctattccctttctagccagtgaaagacccgctgccctttgacctcagccccctccaagcccccaagtttaaaacgccaccccctgccaccagaaaaaacagaaaaaaaaaaaaaaaaaaaaactaaaacacccatctggtctgggcatcttccttcctttttcactatgtatcctgttactgggcttaaacagctttcagagaagagatgtcatttctattaaatgctctttcagtagcgaactgagttcacacttgactaaggatattttccggactgtctgtcatcagcatccttagtgggtttccccatatttaaattggtagaggccagggatggtggctcacacctgtaatctcagtactttgggaggccaaggtaggtggattgcttgagctcagaagaccagcctgggcaacctggtgaaaccctgtctctactaaaaattcaagttagctagctgggcatggtgatgcacttctgtagtcccagctacttggagagggggtggtgctggggcagcaggatcgcttaaacccaggaggttaaggttgcagtcagccaagatggtaccagcctaggtgacaaagtgacaccctgtctcaaaaaagaaaccaaacaaacataaaaaaaaaaacaaaaaaatcggtagagagtgatttctctcccaggcccacttaatgtagactgggcctggctgacacctcaccattcgtgtgatgtgattgctgttctgatgcttagatactcttggcgcagtctcacaattgccaccatggtaggaaggtgtccaggagacggtgcaccttgaaccagtcaccactaaagtggctgcctttctgggtctctccacacatcccctctctctaatttccctacttaatcgtgtgacttcatggtctcaaaggaggaacagaggctgatcttgacttagatatactgaaccatgaaatcactgcatagaatgtggggacttgaatgtgtctttgggcaagtcatttaacctcttaagacctcatctgtaaaatggattagatatgtttaattatagccttagcattaaatattcattgctgttattattaagtgtctgataagtctctgtgtacatggatgtaatcttcctaactcccattacctccatttatagatgagggttatatggccaataaagcctgggtttgaatctaggtctactgcctccaaagccagtcttctctcctgcaacatcatgctctgtctagcaggagatgagaacaggtctccatttggagcctgtcagtggggtcagagactaagattcaggctcagggtctaaattccgtatcctttcttccataccctggtgtttcctatgaacagatagatactttagggctgcaaggtttggattgcatggcactgctcagaagataagttacaggtctgggctaggctgtagctgcccctccaggtggctagacctttcctttctgtgtcaccagttaacactggccaacagttccttccattaactgttcactgctttctcctgtgtctaactgatgcagtttatgacccataactaagagcagtaccaggtatggctctgtttcctgttcatgtcccctgtcctctgggctgcatgcattccgttcttacagaaagaatacctttaacctagtacatcctgccacacatctgcttctactgtgaaattgatgagggggtattaccgattcttccctctcccatcatttactgagatgctggtgattgcattataatcctcttaagcttacattgtctttctgattcttggtcttatctgagcaagtgatctataaataactcagtggctttctcatgactgttttaattattagattttaatcaagtgtcttattaaatatatctgcatgcttccacaggcatctgtctcttcacatggctgttcagtgtgcctctcacaacttagcccaaactcagttgagctgccttgctttggctttgacccagctttccagcgctgctcaatctgttgccatggcaggccattggaaaggctcagttcatccccgtgcctgaagccaagtgagcgctcactccatgcatgcatggaggctgggcaggagcctgcctaatcaaccagccatgtgaggagggagggcctgttccttcctgtaagctatgtcatgaggcagcgtggtcaagtcctctgccagggagtggcctggcccagcctgggcatgttttcatgccagggtgctagagcctactgccagattgtctccctccacccccaatgaaaaaatccttccagaagggaagagccaatttcccctgtattggaggggaagtggcagcacctcctgaagcagttggactttcatcaccctacctctgcatctgcctgaaggacagatttagccaattaacctaaggttaccttcctctctgataaattccccattctgtcttcccatgtgttgtgtctcgtttttttcctcctccttccctcttccttgccccctcttcccctaaaccttacagatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtagggccctaagggcaggtaacactgttaggataaccagcctcttgctgcacctgccccaggagaagagagaaggcccaacctggcatctgggaacagagcctcttctcgtctgtaggaacaccgccagggaggtcatggcagggcagaccaaagggtcctgtggctcagtaggcacagtagatgtcacaggcacttggtgaaggactggtttctgtggagtcttgatcttggctcagctcagaatctccagtgattgggctcctcttggcctttgttcccaggaacatgttcctcaccagctgtccggtgactcttcccctccctctccttttgtgacaaagctctgacaaagctctgtccccctctcgtccctctggacggatgttgctcccctagattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtaggaggcggcagcggctccctggaatgccctgctcagtggtacctcaccttgggggtcctgggagcagtccattgaacaatgctcaggtggcactgagccaaggtaagacccctctgcctgccaccttgggcctgcagggaaggattgagcagagccccttcccagggcccaaaggactctaggtagcactcataaggaatgtcagaacatttggatcaaaagcaaatttatgctggagatttattacataacagtgcacaggctgactacaaatggttatttgatattgaaaatttagtcctctaaaattgtaaaagataccacttttgcttattccagttactatgtgctctttaaaaatttcagttgggaaatgaatttatttaaatgctgtttactgtgcctccatttggcacactagtccctgctgtttttgagccctaaagacaaattgggttccagctcaggagaggttgctgtgctatcttggctgacattctgtgggcctggcagccaggctgaggactgtgtggcctatgctgggcctccaacttgggatcccttccttggcccaggacattgagttaatgtccttcactctcctagttagggagtatgctccttgtccctgtccacaggggagcaagggtttcctggaagaggggagcaaacaggcagtgcccatgcactgaggagcagcagatgggcgtgggcagcccagagaaccaggacacaagctctgtgcagatccctcagcagagggctccagcctcccactcttggctgaacagctccaacccgtagggttgacctttcttaaaaggtccagttcttgctgtttggctattttaagctctagtcttctggggtttcactcagctggtcctggcttcagcaattgcttccctctgaaggccttgcatagaggccaagcgtgaagtgcagggacttctctgctgtgatgtggcttaagtttccctgacacctgttgagtgtcctcataacttcccttctggtgcccctccccagctcctgagaccagctgcagctacaagtgtgcagtgtcagtgttcaagaaagtgcctggcagaggggctttagaagggtcccctgccttccaaaggagctttggcaggcagacgtgctcctgcagcaacactcccatttcctgttcttgcctgctgagtagcacctagatttctaagcctcatctagatactcagatttgattctgggcctttatagcccagttgctgggactgtttcaggagctaggggccatgtggggcagggagagggcacaaaagtagagaagcctgatgttgattcccagggggctggtcagctctgctactgctccttgcagatgtcaagagtcaggtgctagtcacgtgctgcttggcttgtcactgtcattggcagcgagaggaatgggtgctggtgacattgggccagggctgcctctctgtgtcagagttcagggtgtaggaggggttctgccaaccatgggctgtgtggggtaagtgggttgaggctgatctttctgggtcaaggtgatcctgagcccttgcctgtggaatgggggtagagggcaatggtaacctagctagcatgctgtgggggatataggatgaggggctgcccgaccctcgggaggggtcctagggagcagatgttgaagaggccagagccctcagtgagctggatgagggggtgagccgtttgaactccctgagggtacttcctggggcctcgtgtaatggtctcttctgtatgtcccccatcccatctcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggtacgtggctggagcaggggctagagcctagaggagcttggggatgcttgagcattggccaccaacctcccttctcttcctccaggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgccccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggtccttagggcactgggctgttgttccattgaagccgactctggccctggcccttacttgcttctctagctctctaggcctctccagtttgcacctgtccccaccctccactcagctgtcctgcagcaaacactccaccctccaccttccatttcccccactactgcagcacctccaggcctgttgctatagagcctacctgtatgtaataaacaacagctgaagcacctgtttcctctctttt

SEQ ID NO: 3736 - DNA, 1645 bp, Homo sapiens
  Genbank Accession No. X56692
ggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctcatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtggccgtgcggcacgag

SEQ ID NO: 3737 - DNA, 672 bp, Homo sapiens
  Genbank Accession No. X56932
ccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctatgacaagaaaaagcggatggtggttccggctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttc

SEQ ID NO: 3738 - DNA, 4555 bp, Homo sapiens
  Genbank Accession No. X56997
ggatccgcacatctcggcctcccaaagtgcaggcgtgagtcaccggacccaggtcccgccctggcactttttaaccacccacaaatctggatcctacactgaaaagagacactgcagtggctcacgtctgtaatcccagcactttgggaggccaaggcgggcggatcacctgaggtcgcgagtttgagaccagcctgaccaacatggagaaaccccgtctctactaaaaatacaaaagtggccaggcatggtgtcgcacacttgtaatcgcagctactcgggaggctgaggcaggagaattgcttgaacccaggaggcggaggttgcggtgagccgagatcgcgccattgcactacagcctgggcaacgagagcgaaactccgtctcaaaaaaaaaaaaaaaaaaatcctgagtcccgcttgacaccttttgtcaggcaccaccacctttctgggcgaatgcggtagtaccgtctgctctccctgctgctgtcctgaaatccattcaggcacagcggccgagagctttataataaccgattccaggtgttaggtgctttcccagccccgactcctgcgtcctggacccgcagtcctctgcttaatacctttgctttattagaaaacattctcctctactccgttcagctattcgctgagggcccgccaaccgccagcggttgtcaatggcctagaggcagcggacgcaaacacggggagaggtgcaatcgtctcaagtgactcggcgggcggggcccacaaccggaagcgggtgggcgaccttcacccacgtgcgctgcggcttcgttcgccagcatccaagatggcggcagggcggggcccaaggcgcggcgcgaattgtgacgcaggcgtccggcgtgctccgtcgcaagcgctttcggcggcgattaggtggtttccggttccgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggagcgaacgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctcctaatctacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctgagcctcccgagtagctgggattataggcgcctggcaccacgcccagttgatttttgtagttttagtagagacggagtttcaccatgttagccaggctcatcttgaactcttgacctcaaatgatccgtctgcctcggccttccaaagtgctgggattacaggcatgagcccctgcgcccggtcgattctttgtctttttaagtcaacttttatatgtgaacaatgcttggcaggtggttggtagatactaagtgatgttcgtggtttggggtcaaggcaagaagtggggtctggagagttttggtgtaattgagaaggaagctaagagtgttgggtgctccagcttggagttagagaggagagaggctgccacaggaagacatgtgtgttgtaggggatggcttcccatccaggctggcagcaggagcagcctgtgcagatcaggaccttgctccctggaagagggtggaccgccttcagggaagatggatctagcaagatgatgccaaagggtacttattccatcaggagatactgacgagtccttccgccgctaaacctaaggtgaataaccacagtctgtgttcctgaagagcacccgtgcggtcaggagggtggaggacatgtgatcttagttccaggacatgtttagactacaggccagggtgtgtgagaagcctagcagggccaggcttggaggagtgaaaggaagacaggtactggggcaggaccagttggacttggtgcaggcaaagggatagcaactgtggtgtaggcacctgagcttgtgctactcaggcatgcattgctcaccagtctatcctgccgcccatcctcctcagacgcaaacatgcagatctttgtgaagaccctcactggcaaaaccatcacccttgaggtcgagcccagtgacaccattgagaatgtcaaagccaaaattcaagacaaggagggtgagtagggctgggtgtgggggctctggctgtgaactgggagtccctctctcgcccaggggagtctcagtcctgtgtgggttgtgctgactttagatctgttttgcccttgcttctccatgtgatctgaagaacgtttgttatcttctacctcagttggccttttgagaaactgggggtagtgctggagctcccctgcagaggacactgccagtaatatggtccgcagagcctctaactgagcctccctccccctcaggtatcccacctgaccagcagcgtctgatatttgccggcaaacagctggaggatggccgcactctctcagactacaacatccagaaaggtaccggggttggggttgctgggcagggacccaagatccccaggtcctaggaaaggagcattgatggcctcaggggttggggagcagttcaaatgacttgtgttttgtttaaataatgggactgggcacagtggctcatgcctgtaatcccggcactttgggaggcttaggcgggtggatcacctgaggtcaggagttcaagaccagcctggacaacgtggtgaaatcccgtttctattaaaaatacaaaaatcagctgggtgcagtggctcaggcctgtaatcccagcacttcgggaggctgaggcgggcagatcacaaggtcaagagattgagatcatcatgaccaacatggtgaaatcccatctctactaaaaatacaaaaattagctaggcatggtggtgcgtgcctgtagtcccagctactcaggaggctgaggaaggagaattgcttgaactcgggagacaaaaaaaaaaagtcataatgtgaatttttttatcactgcaataaggaaattagtgtcacttgtgggagcgacaagaattcagtgtcctttttttgtgagacagagtcttactctgtcacccaggctggagtgcagtgacgcgatctcactgtgacctccgtctcccgggttcaagcgattcccctgcctcagcctcccgagtagctgggattacaggcacccgccaccacgcccagctaattttttttgtatttttagtagagacagggtttcactacgttggccaggctggtctcttaaagtgctaggattacaggcgtgagccatggtgccccgcctagacttcagtgtctgaccttgcctgaaccacttagaggtcggcttccatgttagaaacccagatggatgcctcagttggcatgtgtcagtctcagactccccccagggctcgtggtcagtgctgagatggagatttcctggggcaggctggctgggacagtgtatcatccacacgtagaacgacggcgggggatcccgacttggtgtccccatcacacttgagaaagcagcagactataggccctggagggtcctgcccctgtgactgaggagccagggctgggctcagtcgccgtccttctggctgtctcctgcagagtccaccctgcacctggtgttgcgcctgcgaggtggcattattgagccttctctccgccagcttgcccagaaatacaactgcgacaagatgatctgccgcaagtatgtgtgctccgatgcttggggggctgtgggggctgccggagtcggggtatgccctcacccacccctcctgtctctgtgcaggtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcc

SEQ ID NO: 3739 - DNA, 7260 bp, Homo sapiens
  Genbank Accession No. X57025
tcactgtcactgctaaattcagagcagattagagcctgcgcaatggaataaagtcctcaaaattgaaatgtgacattgctctcaacatctcccatctctctggatttccttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagatttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaaccttgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaaagtttgttaaaatatgcttgactagagtttcagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacatgttttctgtcatagttagatgtgataattctaagagtgtctatgacttatttccttcacttaattctatccacagtcaaaaatcccccaaggaggaaagctgaaagatgcaactgccaatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaaccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttgcccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttggttttgtttttttttttttttttactttatacagtctttatgaatttcttaatgttcaaaatgacttggttcttttcttcttttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctcttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggactcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacaaaaaaaaaaaaaaaaaaaaaaaa

SEQ ID NO: 3740 - DNA, 1391 bp, Homo sapiens
  Genbank Accession No. X57129
ggacctgtgttacttcccttgtgaagaaacagaattatcatgaaaatttaggtggaaaccatttcgcttttttcttcaaaaataagggaagcatgtgcccaaccacccctgggaaaaagaaccttcaggggcaaaggagcgaacaggtaatttataagaaaaacagaaagtggtcttcttgactgccccagacttccttcggagttgggggaattggggacgcctggacgcgttgtttttgtgtttgtggaaaaaataaatgaaggagcatgaagcccgaggcttctgagatcctttcctgaccaaacccaagtgatttggtgtcggggaattttaatatttttccccttttgtgaggtggaacaaacacaacttgggagcagcgcagcggctcagagcctgccagccaggcgggcgaccagagcaccaatcagagcgcgcctgcgctctatatatacagcggccctgcccaggcgctgcttcatcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtccggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaataggcgaacgcctacttctaaaacccaaaaggctcttttcagagccaccactgatctcaataaaagagctggataatttctttactatctgccttttcttgttctgccctgttacttaaggttagtcgtatgggagttactgaggtatcagacgaattgggtgacggggttggagagtggccgtggtgaggttacagcatttaaacctttattgcggcttctaggtc

SEQ ID NO: 3741 - DNA, 1450 bp, Homo sapiens
  Genbank Accession No. X57348
ccaggcagcagttagcccgccgcccgcctgtgtgtccccagagccatggagagagccagtctgatccagaaggccaagctggcagagcaggccgaacgctatgaggacatggcagccttcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtccccgccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctcttgattcgtaggaattgaggagtgtctccgccttgtggctgagaactggacagtggcaggggctggagatgggtgtgtgtgtgtgtgtgtgtgtgtgtgtgtgcgcgcgcgccagtgcaagaccgagactgagggaaagcatgtctgctgggtgtgaccatgtttcctctcaataaagttcccctgtgacactcaaaaaaaaaaaaaaaaaaaaaaaaaaaaaaaaaaaaaaaaaaa

SEQ ID NO: 3742 - DNA, 2247 bp, Homo sapiens
  Genbank Accession No. X57766
ccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctgcagggggatggggtggggtacaaccaccatgacaactgccgggagggccacgcaggtcgtggtcacctgccagcgactgtctcagactgggcagggaggctttggcatgacttaagaggaagggcagtcttgggacccgctatgcaggtcctggcaaacctggctgccctgtctcatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttct

SEQ ID NO: 3743 - DNA, 915 bp, Homo sapiens
  Genbank Accession No. X57809
ctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagccgctccaacgtcggaagtaataatgttaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcaacatgggatgacagtactgtggtcttcggcggagggaccaagctgaccgtccctggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgc

SEQ ID NO: 3744 - DNA, 1248 bp, Homo sapiens
  Genbank Accession No. X58022
ggacctccggagcagacagcacagcagctgcagaggcaaggccagcatgtcgcccaacttcaaacttcagtgtcacttcattctcatcttcctgacggctctaagaggggaaagccggtacctagagctgagggaagcggcggactacgatcctttcctgctcttcagcgccaacctgaagcgggacgtggctggggagcagccgtaccgccgcgctctgcggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttccttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaagaaatcctcagcaggttgcgagggaataggagactttgtggagctgctggagggaactggattggacccttccaagatgacgcctttagctgatctctgctacccctttcatggcccggcccagatgaaagttggctgtgacaacactgtggtgcgcatggtctccagtggaaaacacgtaaatcgtgtgacttttgagtatcgtcagctggagccgtacgagctggaaaacccaaatggaaacagtatcggggaattctgtttgtctggtctttgaataaccaacccagtgatttacatgctgatagctaagtgagtttttaatggccattgtgtatgattttgatgcacaactagttaaaagcctttcataccagtcagtatttcccagccttgagcgcacgcacacaccacacacatacacacacgcattatttttgttactttgcttctttttatgtttgtaatctgtaaatgaacacatggcagaaaataaccctgattggtagg

SEQ ID NO: 3745 - DNA, 3285 bp, Homo sapiens
  Genbank Accession No. X58528
cggctcgctggtaccggcagtgccatggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaataatgagaaagaaggaaaaaaagaacgagctgtggtggacaaagtgtttttctcaaggctcatacagatcctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagccttcacatattataaaaaggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaagaaaattattttatgttcctcagagaccttacatgacccttggaacacttcgagatcaagtgatatatccagatggacgagaagatcagaaaaggaagggaatttctgacctagtacagaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagccaaccaaattatattagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcatgtaacctgattcatcctgggatgtaaaccattcgaagtcagctaattggacttttatggctctatcttttccttcatgaagaaccctatttaaaactgggtcatcatttgtcctgttctagcaagatagtcttcagtttcatttcctgtgccctgtggtagttggaaaccatatcataatgtattatttaaatgtttaacatcattgcataacacgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggaatattaaaacaccaacagtccttaacatgccaggctcaaggtcttataagagttctagatttttaagagaattagacaaatttgtgtgtgttagaagcccattcattagaagtgtggtggttatttggtattaaactcaaacagtgccaagcttgggaaggcactacaatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctacg

SEQ ID NO: 3746 - DNA, 1195 bp, Homo sapiens
  Genbank Accession No. X59766
cctggggacaatgtgggcttcaatgtcaagaatgttgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacattgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttaaaaaaaaaaa

SEQ ID NO: 3747 - DNA, 2107 bp, Homo sapiens
  Genbank Accession No. X59812
gtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagacaacccatggctgcgctgggctgcgcgaggctgaggtgggcgctgcgaggggccggccgtggctctgcccccacgggcagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaacgagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagaccggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttcttattggaaaaaaaaaaaaaaaaaaaaaaaaaaaaaaaaaaaaaaaaaaaaaaaaaaaa

SEQ ID NO: 3748 - DNA, 2727 bp, Homo sapiens
  Genbank Accession No. X59834
agaagagcggagctgtgagcagtactgcggcctcctctcctctcctaacctcgctctcgcggcctagctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagactacgcattccccggactgttggccaggagaagaagggttactttgaagatcgtcgcccctctgccaactgcgagcccttttcggtgacagaagccctcatccgcacgtgtcttctcaatgaaaccggcgatgagcccttccagtacaaaaattaagtggactagacctccagctgttgagcccctcctagttcttcatccctgactccaactcttccccctctcccagttgtcccgattgtaactcaaagggtggaatatcaaggtcgtttttttcattccatgtgcccagttaatcttgctttcttttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtacgtatccggacagagcacgtttgcagaggggtctctctccaggtagctgaaagggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttggctaaaggaaaaaaccatccaggtcacggggcaccaaatttgagacaaatagtcggattagaaataaagcatctcattttgagtagagagcaaggaagtggttcttagatggtgatctgggattaggccctcaagaccccttttgggtttctgccctgcccaccctctggagaaggtggcactgattagttaacagaccaacaccgttactagcagtcactgatctccgtggctttggtttaaaagacacacttgtccacataggtttagagataagagttggctggtcaacttgagcatgttactgacagagggggtattggggttattttctggtaggaatagcatgtcactaaagcaggcctttgatattaaattttttaaaaagcaaaattatagaagtttagattttaatcaaatttgtagggtttctaggtatttacagatgctgttgctcaacgtctcctacctctgctctgagagatgggacaggctgagtcaaacactgtaattttgtatcttgatgtctttgttaagactgctgaagaattattttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataaaaaaaaaaaa

SEQ ID NO: 3749 - DNA, 1707 bp, Homo sapiens
  Genbank Accession No. X60673
cggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaagcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggacagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttcttttttttttggacatctgttttcactcttaggcttttaaacaatagttattgcttttatccctctcagattctaataactgagagcgatggggctatattgaatctctgtatgcactgagaactgagctatgaagagaatcttattaaactgctggtctgactttatggattgacactgttcctttcttttattgtgaaaaaaaaaaaaaaa

SEQ ID NO: 3750 - DNA, 1783 bp, Homo sapiens
  Genbank Accession No. X61123
cctctcggagctggaaatgcagctattgagatcttcgaatgctgcggagctggaggcggaggcagctggggaggtccgagcgatgtgaccaggccgccatcgctcgtctcttcctctctcctgccgcctcctgtgtcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagcgccccgggccgcccccgcacgccgcccccatgcatcccttctacacccgggccgccaccatgataggcgagatcgccgccgccgtgtccttcatctccaagtttctccgcaccaaggggctgacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatccataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcatttttaacc

SEQ ID NO: 3751 - DNA, 3061 bp, Homo sapiens
  Genbank Accession No. X62153
cggcacgaggcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacaaaaaaaggggggcccggtaaac

SEQ ID NO: 3752 - DNA, 1301 bp, Homo sapiens
  Genbank Accession No. X62534
aatacgactcactataggggagaccggaattcgagctcggtacccggggatcctctagagatccctcgacctcgagatccattgtgctctaaagttgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttctgtgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttcactttaaaaaagccatttgaagaccaaaaaaaaaaaaa

SEQ ID NO: 3753 - DNA, 2564 bp, Homo sapiens
  Genbank Accession No. X62535
ggggcggtcgcagctgaagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacgtagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttccctttgggatctgctg

SEQ ID NO: 3754 - DNA, 529 bp, Homo sapiens
  Genbank Accession No. X62691
ttttttttttttttttccatgtggcattttatttgtaaatatatgtattacatccctagaaaaagaatcccaggattttccctcctgtgtgttttcgtcttgcttcttcatggtccatgatgccagctgaggttgtcagtacaatgaaaccaaactggcgggatggaagcagattattctgccatttttccaggtctttgagttgcacgtcaaatctggggctgatcaccccacacttgtttagcctgcctgtgaggttcacaacaattttcccagctctgtggtcatcaatgatttcaaattcgccaatgtaaccatgcttcatcatcacagtgagaaccggacgatgactttggagccggcctaataagcacctgcgtttgcctctcttttcggcattgttgatactcttgagagcatctgccaggacattcatgcgcaccattgtggcttagattgcaggatggcgcgatggcagacggatgaaattggagctctcagagagtgctactcaccggggggggaattc

SEQ ID NO: 3755 - DNA, 2699 bp, Homo sapiens
  Genbank Accession No. X62822
ctaaaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatgggggcttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatcgtccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgagtttgtggatcagagaaggctttatagcacaggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccagctctgcctggcctgaccctgtcctgtcagctgggtttacataccagtcccattcttccttttcaatacctacccccaaatcttctcctaaccctaga

SEQ ID NO: 3756 - DNA, 2799 bp, Homo sapiens
  Genbank Accession No. X63359
ctgcacaaggatggctctgaaatggactacagttctgctgatacaactcagtttttactttagctctgggagttgtggaaaggtgctggtatgggccgcagaatacagcctttggatgaatatgaagacaatcctgaaagaacttgttcagagaggtcatgaggtgactgtactggcatcttcagcttccattctttttgatcccaacgactcatccactcttaaacttgaagtttatcctacatctttaactaaaactgaatttgagaatatcatcatgcaattggttaagagattgtcagaaattcaaaaagatacattttggttacctttttcacaagaacaagaaatcctgtgggcaattaatgacataattagaaacttctgtaaagatgtagtttcaaataagaaacttatgaaaaaactacaagagtcaagatttgacatcgtttttgcagatgcttatttaccctgtggtgagctgctggctgagctatttaacataccctttgtgtacagtcacagcttcagtcctggctactcatttgaaaggcacagtggaggatttattttccctccttcctacgtacctgttgttatgtcaaaattaagtgatcaaatgactttcatggagagggtaaaaaatatgctctatgtgctttattttgacttttggttccaaatatttaatatgaagaagtgggatcagttttacagtgaagttttaggaagacccactacattatctgagacaatgaggaaagctgacatatggcttatgcgaaactcctggaattttaaatttcctcatccattcttaccaaatgttgattttgttggaggactccactgcaaacctgccaaacccctacctaaggaaatggaggagtttgtacagagctctggagaaaatggtgttgtggtgttttctctggggtcaatggtcagtaacatgacagaagaaagggccaacgtaattgcaacagcccttgccaagatcccacaaaaggttctttggagatttgatgggaataaaccagatgccttaggtctcaatactcgactgtacaagtggataccccagaatgaccttctaggtcatccaaaaaccagagcttttataactcatggtggagccaatggcatctatgaggcaatctaccatgggatccctatggtgggcattccattgttttttgatcaacctgataatattgctcacatgaaggccaagggagcagctgttagagtggacttcaacacaatgtcgagtacagacctgctgaatgcactgaagacagtaattaatgatccttcatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggggaattccgtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccggcagaaaaaaaagggatgcaggggagtcatcatacagggggtggatcatttaccaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctctgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacaaaatagtttcctgatttaacactggccaggaaggtgggctgcaccctcagtctctctctcccatcatggttttcacatgatatcaaaggactctcataacagtctgattcttatgagttgggcatcctgtgtttccctttagggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagggaattc

SEQ ID NO: 3757 - DNA, 645 bp, Homo sapiens
  Genbank Accession No. X63417
tggaacctggtatggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagacg

SEQ ID NO: 3758 - DNA, 698 bp, Homo sapiens
  Genbank Accession No. X63527
ttttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgc

SEQ ID NO: 3759 - DNA, 3171 bp, Homo sapiens
  Genbank Accession No. X63629
gcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccacgtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaaaggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctaggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaa

SEQ ID NO: 3760 - DNA, 367 bp, Homo sapiens
  Genbank Accession No. X64177
ctccagtctcacctcggcttgcaatggaccccaactgctcctgcgaggctggtggctcctgcgcctgcgccggctcctgcaagtgcaaaaagtgcaaatgcacctcctgcaagaagagctgctgctcctgttgccccctgggctgtgccaagtgtgcccagggctgcatctgcaaaggggcgtcagagaagtgcagctgctgtgcctgatgtcgggacagccctgctgtcagatgaaaacagaatgacacgtaaaatccgaggttttttttttctacaactccgactcatttgctacattcctttttttctgtgaaatatgtgaataataattaaacacttagacttgaaaaaaaaaaaaaaaaaaa

SEQ ID NO: 3761 - DNA, 1638 bp, Homo sapiens
  Genbank Accession No. X64364
gccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggccgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaaaaa

SEQ ID NO: 3762 - DNA, 942 bp, Homo sapiens
  Genbank Accession No. X64707
ctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcagaccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcgggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcag

SEQ ID NO: 3763 - DNA, 1040 bp, Homo sapiens
  Genbank Accession No. X64877
ggaattcggcacgagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaggaaaaatagaatcaatggcattactattagtaaaatgcacacctttttctgaatttactattatatttgttttcaatttcatttttcaagtactgttttactcatttttattcataaataaagttttgtgttgatttgtgaaaatgcaattacaaaaaa

SEQ ID NO: 3764 - DNA, 439 bp, Homo sapiens
  Genbank Accession No. X65614
ggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctgcagagccatggtcccaggcttcccaaaagtgtttgttggcaattattcccctaggctgagcctgctcatgtacctctgattaataaatgcttatgaaaaaaaaa

SEQ ID NO: 3765 - DNA, 147 bp, Homo sapiens
  Genbank Accession No. X65727
cattcattcactcaggcttagagaaacctccaggagactgctaccatggcagagaagcccaagctccactactccaatacacggggcagaatggagtccatccggtggctcctggctgcagctggagtagaggtaggttctgagtta

SEQ ID NO: 3766 - DNA, 1346 bp, Homo sapiens
  Genbank Accession No. X65962
cgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcactattgaaaacttggtaatcactgcagctgacttacttggagctgggacagagacaacaagcacaaccctgagatatgctctccttctcctgctgaagcacccagaggtcacagctaaagtccaggaagagattgaacgtgtcgttggcagaaaccggagcccctgcatgcaggacaggggccacatgccctacacagatgctgtggtgcacgaggtccagagatacatcgacctcatccccaccagcctgccccatgcagtgacctgtgacattaaattcagaaactacctcattcccaagggcacaaccatattaacttccctcacttctgtgctacatgacaacaaagaatttcccaacccagagatgtttgaccctcgtcactttctggatgaaggtggaaattttaagaaaagtaactacttcatgcctttctcagcaggaaaacggatttgtgtgggagagggcctggcccgcatggagctgtttttattcctgaccttcattttacagaactttaacctgaaatctctgattgacccaaaggaccttgacacaactcctgttgtcaatggatttgcttctgtcccgcccttctatcagctgtgcttcattcctgtctgaagaagcacagatggtctggctgctcctgtgctgtccctgcagctctctttcctctggtccaaatttcactatctgtgatgcttcttctgacccgtcatctcacattttcccttcccccaagatctagtgaacattcagcctccattaaaaaagtttcactgtgcaaatatatctgctattccccatactctataatagttacattgagtgccacataatgctgatacttgtctaatgttgagttattaacatattattattaaatagggaattc

SEQ ID NO: 3767 - DNA, 983 bp, Homo sapiens
  Genbank Accession No. X66364
cgcaggggtcccccggccgccgcgatgcagaaatacgagaaactggaaaagattggggaaggcacctacggaactgtgttcaaggccaaaaaccgggagactcatgagatcgtggctctgaaacgggtgaggctggatgacgatgatgagggtgtgccgagttccgccctccgggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgagattgtaaagtcattcctcttccagctactaaaagggctgggattctgtcatagccgcaatgtgctacacagggacctgaagccccagaacctgctaataaacaggaatggggagctgaaattggctgattttggcctggctcgagcctttgggattcccgtccgctgttactcagctgaggtggtcacactgtggtaccgcccaccggatgtcctctttggggccaagctgtactccacgtccatcgacatgtggtcagccggctgcatctttgcagagctggccaatgctgggcggcctctttttcccggcaatgatgtcgatgaccagttgaagaggatcttccgactgctggggacgcccaccgaggagcagtggccctctatgaccaagctgccagactataagccctatccgatgtacccggccacaacatccctggtgaacgtcgtgcccaaactcaatgccacagggagggatctgctgcagaaccttctgaagtgtaaccctgtccagcgtatctcagcagaagaggccctgcagcacccctacttctccgacttctgtccgccctaggccccgggacccccgcctccaggctgggcctggcctatttaagccccctcttgagagggtgagacagtgggggtgcctgg

SEQ ID NO: 3768 - DNA, 66109 bp, Homo sapiens
  Genbank Accession No. X66401
  unsure (1)..(66109): n = a or c or g or t
tcgacgggatcacgaggtcaggagatcgagaccatcctgactaccacggtgaaaccccgtctctactaaaaaaaatacaaaaaactagccaggcatggtggcgggcgcctgtagttccagctactcgggaggctgaggagggagaatggcgtgaacccgggaggcggagcttgcagtgagccgagattgtgccactgcactccagcctgggcgacagagcgagactccgtctcaaaaaaaaaaaaaaaaaaaaaaaaaaaaaaaaaaaaaaagaaaaggattgtaagagttactgttacattttctggcctactacctttaaaattcctgttgcatttctttgtatttacaaggaaaagactgaactttttctcatcaaaactagcttttttctcacaggttaaacttgcaccaatgtctgctctttttttttaatgtttttggtactctgggcagacttcagttttttaaaaaataaagattctaatgcagctatcttggcattccctttaaatacctgtcttaacctcctacttttatttcctactcctttccacacacatgcatacaatcctttaccttttaaagaatcattaagactgtcacacattaggaactctttcgctcactcttctgtcatttgctgcaatattgaaattcttattttgaccatcaatgcctattaattcttctaatacatgaagaaaatgattgagtagcagcagtactataggtgggaaatacagtttaactgctgaatttttatacctctctgatttatagcttgctaattaaattgctattaatagtttgtttggcttaattagacttaagaaaacaacaggttttttttttttgaggtttttttttttttttttgcatgaggagagaattgtatgtaaccagtgatatgattattcctgaatgtacagacagaagtaagcctggacattgtttaatttaaaaactttagtccctgctttaagggaatatgataatgtatactatgacaaatgtactttattcttctaacacagtaagaattacttggaactttttcctgaaactaagtgcaggaaagccctgtgtgtcttggtttagtgatggtttcatttctagccatacaactgatggattgtatacaatttttgttagtgccaaaataatctgttatatgaacagacttctaaaataatttctgtatattatatatgtaagaaggcttttattgaacagcttattttccacttgcaagtttatggaaatatcaatatgtcaaaataaaaagtgggacaattctttgctgttagaagaatgtgcttattattttgatttcttaaatggtacataatcaaagtactgctgaactataggtgcagtattctactaaacatttcagctagtaataccactgatttagaaacaaaactgtttatttttgctttctgaatttagaatgctgggattacctgtttaaatatgttttagggaatatagagattaaatctgtacatacctgtgcacatatattcatgcaccctctgattttggttttctcgtttttgagttcttagaaagtatccacatactcttcttttagtagaagtagctgttttagagagaagaaaaggatgagactttaaatagttgattctttttgtgttttctacaaacttttttgaattttaaatcacaagcaaactaattttctggtttttagaaagtagatgatgatttcagaggagtaagacatgccaaacagcgtgctcggtaggattttaggtagtcaaatgcagctgagaaaaagtattttcaagtcataagttgctaattgatatgctatgaactagtcaaaataggaaccatatgattcatgttagattttcctctagagatggatctgaatgttcagttccagccaaggtagattttactttcaactttttaatcaatatcactttctgtgcttaatctctttggtgttaccttgtccattttcatttgtctaaaattctgcagggatgactacaatttggcataatggtataaatgaattgttaagggtaactttaagttgaagattaaagcaagatgccattttccccatgtctttcattttgtttacattttttccctttaagttagtatacactacacatactacaataaaatataataatatgaaaaaagaatattttagatattctagtccctttgcctttccatgtaaattttagagtaatcctacctataattaacaaatcttgcaaagattttgattggaattgtgttaaacttgtatattggtttggggagaattgacatatttactatattgaatcttccaatccatgaacagtatttctctccacatagatagagactgaatagatcttctttgatatcgttcaccagcattacatagtttttagcttgcaagtcttgcatgttttgttagatttacacataagtgtttcatgtatttgagtaattgtaaataatatatttatatttttgggccaggcgcggtggctcacgcctgtaatcccagcactttgggaggccaaggtgggcggatcacaaggtcaggagatcgagaccatcctggctaacacggtgaaaccccgtctctactaaaaatacaaaaaattagccgggcatggtggtaggcgtctgtagtcccagctactccggaggcaggagaatggcgtgaaccccggaggcggagcttgtggtgagccgagatcgtgccactgcactccagcctgggcgacagagtgagactccgtctcaaaaaaaaaaaaaaaaaaagaaaaaaaaaaaatatatatatatgtatcatttgttcattgtgagtatgtagaaatacaattgatactggtttatcctgtattctgttaatttgctgaaatcacatatctagaagtttttctgtagcttccttgtgattttctacatagacaatcatgtcacttacaaatgggagctgtttatttcttacttcacaatctgtatgcctttaatctcctttttcatgcctattgcactgtctagaacttccaacactgtgaataagagtggtgagagtggacattcttgccttgttcctgattttaggtagaaactattcagtctttcagaatcaagtatgttcaccataggatttttgtagacgatctttatcaagtaaagaaagatctcctctactcctatatttctgagattaaaaaaaaataatgaatgggtgttaaagtgggttaaatactttttcttcatcaattgatatgaacaagtaaattttcctcttcagcctataatatgatggattacattaattaattgtgaatatccaaccagctttgcatccctgggataactctcacgtggtcattgtatataattctttttatatgttggtaaattccacttgctaatattttgttaaagattgctgcatcatgaggaatattagtctacagttttcttttcttcccattgtcattgtttggttttggtattgaggtaattctagctttataaaataaactgggaaatgcttcctctgcttctattttctggaagagattaattggtgttaattcttctttaaatctttggtagaattcttcattgaaactatttgttcctaaatatttccttttgtgagtttttaaattatgaattcaatttcctcaataggtgtagacatttttgaattattttatatttagtgagttgtggcactttatattttttgagaaaatgatccatttaatttaagtgtcaaatttatgtgtgtagaattgttcatagtattcttttgttatccttttgatgtctgtagaatctttgatgatatcccatttcatttctgatgttggtagcttctatcttctgtcgtctttttttctgagtcttgctagtggtttgccaattttattaatctttcaaagagccagctctttgcttcattgatttttttttgcttttgtttttctgttttcagtttcattgttctgcttgctttttattttgttattcttttactagattcttgaggtgagagtttagattattggtttgagacttttcctcttttccaatgtatgcagttagtgctttaaatttacttctcaaatgcaaatcaaaaccacaatgaaatgccatctcacgccagtcagaatggtgattattaaaactcaagaaacaacagatgctgacaaggttgtggagaaatagaaatgcttttacattgttgatggaatgtaaattagttcaaccattgtggaagacagtgtggcaattcctcaaagatctagaaccagaaataccatttgacccagcaatcccattactgagtatatacccaaaggaatacaaatcattctattataaagatacatgcacttgtatgttcattgcagtactattcacaatagcaaagacatggaatcaacccaactgcccatcaatgacagactggataaggaaaatgtacatatgcaccatggaatactatacagccataaaaaggaatgagatcctgttatttgcagagacatggatgaagctggaagccattatcctcatcaaactaatgcaggaacagaaaaccaaacaccacatgttctcacttataagtgggagctgaacaatgagaacacaaggacacagggaggggaaaaacacacactggggtctgtctggggcgaggttggagggagggagagcatcaggaaaaatagctaatgcatgcttgtcttaatacctaggtgatgggttgatatgtgcagcaaaccaccatggcacatgtttacctatgtaacaaacctgcacatcctgtacatgtatcctggaacttaaatttacctcttataactactataactgtatcccacaaattctgatatggcatattttcatttttgtttagttgtgtttattgtgtgtatttttaaaaaatttccttgagacttcctccttgacccatgtatttctaagtgtgttgttttgtctccaaatgtttagatattttcctgttgttgatttctggtttggttccattgtggtaggagaacactttctttatgattttatttaaaaaatttgttggtcttttattgtcttagatatggtctatcttggcatatattctgtgggcacttaaaaaaatgttattctggctgggtgcagtggctcatgcctgcaatcccagcactttgggaggctgaggtgggtggatcacctgaggtcaggagtttgagaccagcctgatcaacatggtgaaacctcatctatacaaaaaataaataaataaataaataaataaataaataaataaaaaattagccaggcatggtggtgtgtgcctgtaatctcagctactcaggaggctgaggcaggagaattgcttgaacctgggaggcagaggttgcaatgagccgagattgtgccattgtactccagtgtgggcaataagagtgaaactccatctcaaaaaaaaaaaaaaaaaaagtgtattctgccatggaatactatgcagccataaaaataatgagatcacgtcttttgcagggacatggatggagctggaggccattatccttagcaaactattgcaggtacagaaaaccaaatactgcatgttctcataagtgggggctaaatgatggacacatggacacaaagaggaaaaacacatactggggcctattggagggtggaggttgggaggaggcagagggtcaggaaaaataactaatgggtactagacttaattcctggatgatgaaataatctgtacaacaaacctccatgacactgtttacctatgtaacagacctgcacatgtacccctgaacttaaaataaaaggaaaaaaaagaaaaaagaaaaaggaaaatctcgtggaatctactaaaagcaacgaaaaagaaaataatgtatcttctgttgttgggtggtgtgttctataaatgttgattagatcttatggtttgatgttgtttattcttctatgttttttctcaatttttgtctatttgtttaatcaattgttgagagaaaactattgaagtcttcaactatcattgttgacttgcctattttcttttcagttctatcagtttttgctttacataatttgcagccctgttgtttggtgcatacatatttaagattgctatgtctttttggtagatttacccttttattattacatagtgttcctatccatttctagtaattttctttgttctaagtttatttgatattaatatagcctccctttattattttttgtctgatatatgtttttctatcctttaacttataaaccgcctatatcattatatttgaagtgagtttatcataaacagcaaataattgagtctttttttttttttttttgagacggagtctcgctctgttgcccaggctggagtgcagcggtgtgaagtggtgtgatctcagctcactgcaacctccacctcccgggttcaagagattctcctgcttcagcctcccgagtagctggggctacaggcttgtgccaccacagctggctaatttttgtacctttagtaaagatggagtttcaccatgttagccaggatggtcatctcctgaccttgtgatccacctgccttggcctcccaaagtgttgggattacaggcgtgagccaccgcacctgacagagtcatatttttaaatctattctgccaagctctgtctcttaaaattgatgtatttaggcgatttatatttcctataatattgttatgtccaggcttaagtctgacattttattttctgttttctgtttgttctctctgtttttcatttctttgttttctttttcattgcttcctaaataattttaaaattccattttaatttatctatagctgtgtgtgtgtatgtgtgtgtacctctttggatagctcttttagtggttgttctaggtattacattatatttatgtaacttatttattgtcattaattaccagtctgagtgatgtgtagaaatttcttctctctttgtttaccctccctcatttataattgcctgtaatattttctctatatacatttataaccatatgatacagtattatacgtttttcttcaatcctataatttaaataactcaagagaagaagtaaagtccattttttaacccatattttttcttgccatgttctttcttccttcctgatgttccaactgtcctcaatttaactttttgtttttttagggtagacctgttagtgacaaattctgttagttttccctcatctctgtatgtcttaatttccctggatatttttgctgatatagtgttctaagttgatatttttttttcctttcagcactggaaaaaggtggtgacctccttcgggcttacacagtttctgatgaaaattttgctctgtcatttttttcacctgttagatgtcatttatctcactgctttcaagattctttttatctttaatttttagttaattactatgattttggtgtggctttctttgggtttgtcctatttggggttcactcaccttcttaaatcactaggtttatgtcttctgccaaatttgggaagttttcaaccatatttatttgataatttttttcagcttcactctctttttcctctcattttgggactctgagtacatgaacattaaatcttttgttatagccccatgggtccctgaggctttgtccattttttccagtgtattttctttctttcttttgttcagattaagtgattgctattgctgtgtcttcaaggtagctaattctttcctctgttctctccttctgctgctgagcttatttactgggctttttattttggctattgcacttttcagttctaaaatttccacgttttcttccgtatatatcctatttttatgctgaaacatcctatttttttcttttctgctcttttcttcttctttctttttttaaaccactgaactggacatcctatttttttcattcttttaagtgttaattgctcatcaaagcattttaataatggtggctttaaaatcttcatcaggcttttctttccgttttggcatctattttattgtcttttaaaaattcaatttgagatattcctggttcctgatatgacaaataatttccaattgaaacttggacatttcaggcattatgttataaggctattggtcttatttaaactgttttagctggcttcttttaacacctctccagcaggtaggcaggtgagcttcatgacgccaggtaggggtaggagtccaggcttctcactctgccttcattgacacctcagataggtccccattattactgagtggggacagaaattctggctccctattaggtgcccactaatacctccctggttggttgggagaggagtgccacttactatccctcacatgacctttattgacaccaagatgggacagtggagtggaggagtgagtggtaggtatcagggagtggttgctggattaactctgggtggtgatgaaaatcctgactctccattaggcattgtctgacatcaccctagaggagaggggaagagatgcttcattactgttgggtgaggaatggaagtctaggtttccattgacatttcaggggcttggggaaaggagtacattttcaccaagagggcatgaccatcctgactccctattcactttctctgacaccatcctggtgtgtgtgcatgtgtgtgttgaagtgttgggttccttatgacagcctggtgagggtgaaagtctaggctcctcatttgaccttagctggtgggggtggagtcgcagttttttctgtggtgtttggctggccccattacccaagatggagtgtagtggtgcgatcatagctcactgtaacctcgaactcctgggctcaagtgatcctcctgcctcagccttcagagtatctaggactatgacacatcgaactatgcctgactaattttattattattattcatagagacagggtctcattatgttgcccagggctggtcttgaactcctggcctcaagcgatcctcctgcctggcctccttcccaaaattactttaaatgatataatagctgacagcttgaataggtcctctttattttgttggaggcagagtgttagaagtgacctaacaaaaaggatttgtttcttgtcactagactcattcactgtgtcaatgagtgtgtcagtggtttgtgggaagcaaacttaaatgaaaatgtatatttttaattaaatgttatgagatgctttttttaaactattggctcttgtgaatttcagaaaaatattgcaagtcatttgacttagctacttagcttgcactctatgtaaaaattttagaattttacctctttgaaaaactcctaatatcaatagtgatattgttgttttgcagcctcaaatgattttgttactttggactaattttcactgagctagttaataagtgactttttattgtctaaaaaattcttaagtgtatcatagagagaaagattattgggtcactaagtggctttctatatatatacctttgtccatatttaatttttgcaaaactcaaattaaggtggtaaacttagtgtggatatacattcatgtattgtattgataagattaactacgttttaaaactaaagtggaaagttttaaacaaaattgtcattcaactatatatgtatttctgtaaaacacacacgtaatgatgaattcgaattaataagcaaaaaaggagaggatttgtaatttaaaattgatcttggaatatacactctacacttaagacagagaaaaaactttttctttccctttagcataatctgcccagctagcggtggtttcttatcagaatgctctcacttaataccttgataacttttagtgctttgtgctgatagcatcaagtttttaaattattttaaaaacaaacaacaacaaaaaaccatttgcttctgaaacacctaaagtttcttataattgttaccttctttatgtttattttcaaatgttttattgtcactctggttattgagatatcaaagttataacaattgctcactctcaggtacctatgcacttaagtgaccagtttctctgaaaattcttttttgttgttgccttcttccaacctcataccctgaattcagaatactaacactgtcaagctatttttcacgcccccaaatctttgttttttctcactagacagccactacccatttggccactaggtggcgcaaaaggcttaatttttcaccttcctccgcctactgtgaaggaagctaaaagtaattagatgtgtttggcatgatttttatattttaaattaacgctgtactatcaaaagaactacctgtgtctcaaacccacaatgtggtaaaagctgacaaataaaaaacagtagctcaattttctagattaattttgtccaggttaaaaatattattgatatatgttttagtgaccacataggtttcagtaagggtaaaaggatgctcttgttcgtactccaagtctggcatggtgactgtcaatacattcattttgaagaagattttgcttctgggtttagccctaaaacaggccaaatagagacgataaaatgagtggaactgaattagagcatttctgaaaagttttatttggttaattctgccccttaaggtcagaaattgtgtaggaaaagtgtttcaaaattataaataaggcaaaattgtacgtgcttgattattttatatcacacttgaacctttgctcataattctgcctgatcaaaaccagagtgtttcagggattgtaatttgcctaagacgaacccggccagccctgtgcgattagaggttaatcagcagagagctgataagggatgctggctttctctttttctccggtaaagaagataacaccaaggttatgattttattgccctctagcacgttagccattttgaatctctagcctagaaattatttcctcacagagagatacagctctgtttttcaaatactctttggatcaaggctcttgtattcttgctggttccctctttgagtttgataaaactttgaaaagtctaccaaagaaatttctctcagaactagactttagagaggaaatgctggaactacggatgagaggcacatgtatgtacagggtcagaccacgcagagagcaggtctgatgagccacaccactgctgctgccccatggcttctagacgctgctgttggttctgttgttaggacctggaggttgctgcagccaccactgaagacacctcctaaaccacttctgtttcaggaacttcacttaaaaaaaaaaaaaaaaaaggaaaaaacccaccgcttccccaaaagacagttgcttcttctgtcacctttgccagagaaataaatacagtaaaaggtgctctgcaacccccacaccctggttcctcctgtggcccctttgtaactgaagtcttaggtggatgaatttaattggtggaacttaggtgctctagcttcaaagaaggctaggggaagtgagctttctggtttccactttagggaggcaggactcaaaaggtaggggaaatttcacagtactctaaaggtgttcaaatcccatgggcagccagtaaacatcacaggtgtgaggtgctgggtggagtggctgccgtgaatatgtgttttggttcatggactacatcagtggctcttaaagtccagtaattcacagattcatgagagataataaaatgattatttttgttttaagccattaagtttggagttggtgtgctgcccagcaatagataatggaaacatacagtatgtatttctgcaagtctggcttcttcacttaatattgtttctatgagattcgtccatgttgttacattttcagtagttgatgaagtttcattgtttacatagtactgtgttgcacgaatagactacgttttgtttatccatttactgttgaagaaccattttgttaaacaatttgagagtaatctgtggaaattatgccacttgacccctaaatattttgtcatgtataatttaagaataaggacatttctcctgcaaaaccctaatactgtcatcacccccaagatacttaaaattgataccatattatcaaacacacaatccatattaaaaaatcccctattgtcccagtaacaccttatagtaaatgtctgttattttaagcgggtgtcattcattacatggcaataggtaactaatacggtgagtctgcttcttccagcaaggaccctcagggggtgcggtgattcatagttctcactcagacttctctgtgtctgctcatatgtccctatttcatatctcagggtccggtctatcccaaccaggggtcttgccttatcacaacagctgctgttggatgatgcaacaaacatttctacaacttcataacctttatcataagcccccgggcttgaccctcagccatatctgtgctgggttgcaggagaaaagatagcctttaaaactgctatagaggcatttacagtttttcattcatgtcttgagtttggattaaaggcttttaatttgtctttttttcctttgtatgctcttgagggcagtctgacgcagccagtctctgaaggttggcacaaaagcctccatcgagtcacccagcttttgcctggtacctatcctaacctaaaaccttgccacatgttaccttggcgaaaggccagtgccacacttcagtgatgattcggctgtcctacttggttagaaccgagttcacttccttcctcaacactcctgccacattgatctggaagtttcaccttgagccaagtgatagttaattttatgtgttaacttggctaggctatggtttctagacatttgaataccagtctagatattgcagtgaaggtattttttagatgagatttacatttaaatcaatagattttgggtaaagcagattaccctccataatgtaagtggcccttccaatcagttgaaggtcttaggggcaaagactgaggtcctccaaggaagagggaattctgcctctggaccaccttcagactcaagccgcaacatcagctcttcctgggtctccagcctacctgcagatttcgaccgtgccagctcccacagtagtatgagccaattacttaaaataaatctctctctgccaacatcctattggttctgcttctctggagaatcccgactcatacaagccactttctatagaaggctgtttcttcgagaaatccaccctcttctatgtcaacagagtttagaatctccatactttatctcttcatttttgagaacataaattctgtattacacatacttatactatactatatatgaaactttcataaacattgctgggcaaagttgaatattgctgaaccaatttccgatgcttctgaataagttcaatggagttaaaacatttttcttcttacatggtatgtccagtgccccagagccagcagagttaagaacttggtaaggaagaccaaagataatccatatattctagtttgttatataatataaaacatgtttattagattctaaaagacataaaaagaaaataatacatatgtatcagtgagagaggtgcaaattaggaagagaactaaggattattcttaattcctgccttcctttctaaatcccaatcctcaattgaactctttaattatatttcctgtttattttattgaatggaaaaaatggaaaattatctaacatttgtcatggaaatataggagaaattactctcagagatatgatgttatttaagtcattgacatattgttaacctcagatgcaaatggtggaattaataatattcctcagttcatggtacatagtcactgttggtctagtgctagtttgtagttgtatttgtattttttattttttagaaatacggtcttcctttgtcacccaggctggagtgcagtggtgtgatcacagctcacagtaagctcaaactcctgggctcaagcaatcttcctgccttggcctcccaagtaggtaggactacaggtgcatgccaccatgccagctaattaaaatgttttaaatttatttttggtaaatggggtcttgttatgttgcccatagtttttagtgctatgataagctagtaattatagtgaacattcttgtcttggatacccaaggtttttccgttatgtatactagtggttacagattttttggattataacctttgccaaaataggaaagttttgattcctgcttccttaactgtttttcaaaaatcacaaatggatatactttaccaaatgtcttttattaatagactgagcaaaggaaatgacttttctatgaatatggtaaattatagcaacaatatgttttattatattgaaccaccctagtattccaaggattccctatttgatcttgatgtatcattattagcataatcattattattattgttattattatacatatttttagagacagggccttgctctgttgcacaggccgaaatgcagtggtgcaatcatagcttactgcagcctcaaactcctgggctcaaatgatcttcctgcctcagcctccctagtagctgagactacaggtgctcaccatcacacctggctaattttttaattttttgtagagacaggatctcacaggatctcagtatgttgacaatgctggtcttgaactcctggcctcaggcgatcctcccacctcggcctcccagtattattatttgtaatattgttgaattcggttcataaataattatttttttctcccatctgtgttcaaggtgaaatgggtctattatttttttttccttgagttttccacaactcaatttggagtcaagattacactcggctgataaaattagctaatcaggtttagtttttttctgttttctggaaaaagtatataatatagaagtttcatgttccttgaatgtttgatagaactcatctgtgaaaccatctgggcattttcaaaaatatatttttttattagatgccattgataactttaaaaattgctttaatactcattggtatagtcaagttttgtatttctttttgtgctaattttgatagattaaatgtttctaggaatttgcttatctcacctaggttttcaaatttattagcatatacttgttcataacactctatgctttatatctgtgtcatatctgtagctgttccccctttttcattatgtatttgtttattcattttttctccctttatccataatcggccttgttgtaactctgaatatcttacaaatatttttaagtaagcagcttttggaatcaaaagtatgttaattttcactacctagttttttgttctctatttctgtttcattgctttctattcttatctttataactccttttcttcgtatttctttaggtttgctcaacttctctttttccaaatttttgagtagaatttctaggtcctttattttaacttttcttgttctaataaatgtatttgaaattataatattattttatatgtatattttatgtgtaacatttttaacacctggttctaaaagagttaattttctttataactgctgtttatttatttgacacagggtcccactctattgctgaggctggagtgcagtgacgcaatcatgcctcactgcagcctccatcttctggactccagcgatgctcccatccacgactgccttttaaatccatgttactgataaatatatttgttcacttacaattttaagtatattttagttatcaagttctaattttattacagtatggttgcagaatatagtttctttctttctttttctttttttttttttttttttaagacagtgtcttactctgttgcccaggctggagggcagtggcacaatctcagctcactgcaacctctgcctcctgggttcaagcgatcctcccgtctagccttctgactagttgggattacaggtgcaccccatccagctaaattttttgtagagacggggttttgccatgttgcccaggctggtctcaaactcctgggctctagggatctgcccaccttgacctcccaaaatgttgggattacaggcatgagccactgctcctggcctagaatatagatagtttctaagataccgatactctggaatttattggcgttacctttatggaatgatgcatgtcctatttgagtaaatgttctgtgtggcttgaactattatatataatttttggttttctggcaacttttaaaaaatgaattttatgaatcttgtacctcattttatttccttctttgctttcactatcctatggcctggagccaattattttttatccatttatagttggctgataaatatgtgtcctgttaaaccggctctctgaagaaaaacaatgcttctgacttgtagcattgctgatttctatagtataaatacttccatagtggtcaatatcaagttaccaatagttaacaactgtcttcaaaaatcctgaatactttgcagtctgctcttgctagccagtataagacagcgcaccacttttttttttttttaagatattcacgttgtccattagtttccattagtttcactccttggcttcacttacttttcttaaccatattttctctctgacccagtgttgttttcttcttttaaaaattgttttaaattatctctgtaagctgctacaaaccttttattggaatgaagggcattagaacagttatttggccaatacagaaaaatgaagtcttctaattttttttttttttttttttttgagatggaatttctctcttgtcgtccaggtggagtgcaatggcgcaatcttggctcactgccacctttgcctcccgggttcaagcgattctccctgcctcagcctcccgagtagctgggattacaggcaccatgcccagctaatttttgtattttaagtagagatgaggtttcaccatgttggccagactggtcacgaactcctgacctcaggtgaaccacccgccttggcctcccaaagtgctggaattacaggcacgagccaccgcgcctggccgaagtcttccaattttaaaagatctaatcttcattcagttctcaaagtctttgctgtgcccttaaggcatgtcacacgcatgtgcagctcaggggtaacctggtactcctgagggttcagactcagaattagggaatttccgcctgtactctcagtttggagattcccctacacattcctgcccgcaggggccctttttcttcattcctctggccagaaagccggtatttctcttgttaactcagggcttgtgctaccacgcagtgcagctctgcacctgaggcctgacgtcagggcagagctgggaggaaaaaaggggaaaacattgaaaacccactccccaggaggggcccctctcccagttttgaccctcttcacaatccacctgcttttgtttactttttggagtccttgagtacttgctttttgtatactgcccagaatttctacttgtgatcagtgggaaaaatgggctatttaaaatctcaaataagttaaatatcatggctagaaacaactccaggcatttgtaattttagatttttttctttacactccagggggatgtgattgttttagagttttgaattcgtatgtttagcctgagatcctactagtatttctgttgaatatgcctgttgactgcccacttgttagcaaaatggcattgaatgttggaactgtaaactaccttagaaatcattcagcaccatcttttgacagaaaaggatatgagagttcactcctgtcactcaggaagtgcaaggcaaagatagaagcagaattaaatttgttttaatacagttactcagccatctggtaacagtttcctaagtgccaacgaatgtatggggctatttattgcagattttaagatgatatatggggattgagggaatgagaagttttagggagtggtagaggaagggcatataataagactgaatcccagatcccagcctcagaacttattttgtgaccttggtcaagtgatttaatctttccaaacctctatgtgtcctatagaagtaataataatacctatatagggttgggtgttttttttgtttgttttttctttttcttttcttttttttttcttaagatagggtctttctctgtcacccacgctagagtgcagtggcgcaatcacagctcactgtagcctcaaactcccaggcctaagcgatcctcccactcagcctcccaggcagctgggactacaggcatgcaccaccgcacccgactaatttttaaatttttttgtagagatggggttctcactatgttgcccaggctggtcactaactcctgggctcaagcaatcctcccgccttgacctcccaaagtgctgggattacaggtgtgaatacagggggttttttggtttgaattttaagagataaaatttataaaacatttagccaatgccacaaatgtagcttcttttggttattgtcattattctttgaaattcacaagtgccccaaaatatttaagcatttttcatgtattgccctttaatatgaatgaatgcattatgaaaggaattcttttacatgcgagtttgctgatagtcttagctaattctcatgtgtgtaggtgtcttgcctatctgtcagtcttagccttaaaggaaagagtcccatcacctcacttgcggcctcatcatcatggaccgcatgatgatgcggaatgagaatttttattgtttgtactacttcaaaatcattcagtacgtgatcacctgtcatgtatagggctctttatatttctagtttagtcccttttgttttctctaggaaagatgttttagacctgggacaaaagaagaaagagtgtatgctgacatctaggagggaagcacccacctcccctaagctccatctccctgagcactcatttcccaatgaccataccaggttttggccctagagagtttattacaaaataagaaagagaagtctggggaaggttcactcatcatagaattttggcagttcattgcccaagatgactcgatggtccacaccggcagctgtaatagtgaccaggtagatgacacccccgcttgagccatcccggctcatggccagagcaatagctgcagagggtttcaagttggagagagggagagagaggatggcttagcttcaaaaatctttttactccccctccatccatatgcctactaccactttcacctcaaaactcatcttccaggaaggcatatttagtggtgtgctggtaaatcagtttttttacaaaaaggcttccatatgtggcatctgctgatgtccgtggtgtaaatgctcccgctatgatgaattgcaagttacaaatagctaagcagttcacaaatccttgactatttaacagtccgctctcatgagtggtcccaagccagcctcagcacacctcagcacaccactggttctttttttttttttttttctccagacagggtctctctctgtcacctaggctgcagcgcagtggtgcaatcaccgctcactacagccttgatctccccggctcagatgatctttccacctcagcctcctgagtagctgggactacaggtgtgcaccactatgcccagttcatttttttttttacttttttttattgttttttgtggagacagggtttcaccatcttgcctaggctggcctcaaactcctgggctcaagtaatcctcctgcctcagcctcccaaattgttggcattacaggtgtgagccactgtgcttagcacaccactggttctcacagtgactgtgtatcctcatttgatttactcagaacagccctggtttatccgtattgcccaagaaccccattgagctttgcatttgtcctgccccttttcactcttaaaagtgtaccaggcccggcattaacttaaatggccacccctgtatttctcttcctgttcctcataatctacttccttcccatgtttcaaagccctccccaggtacccttccacttggctggttaccgtctgtggtgaagcgcctgcactcctcgggagacatgcctggcttatatgctgcatccacataaccatagataaaggtgctgccggagccaccaatggcaaaaggctgtcgagtcagcattcctcccagggttccatatacctgggaaagggatcctcaggttaaagaatcatcaagcccttccttcccactgagacattaagtggtctctgcaccctgcaatgaagccctggtatctcatatccccaaagtactatgctttcagaggtagtgtccttggaactcattgctagaatgacataggacttccatcttcctctgcaggagagtggggaagcccagaggagagagtgctttgggagaaactcacctgacctccttcacgttggtcccagccagctaccatgagatgtgcagacaagtcctctcgatatttatagctgatatttctcaccacatttgcagcagccaaaacaagtggaggttcctccagttctatcctgagggaaatattaggaataaaggttgatagaattttaagtctcattctcctatactgttaccatcatccctgctaaacgacccctgaaaactgtaactgcaatagctcaaactgcagcctccctcccacatgtacaggggaaccagagtcccacaccaccaactggtaagaagctttcaattgctcactcttttgctcagccccacccacataactttcttttggctgcaaggaccctgctcttatggggaaaagcagataaggttacttccgtcccaacgaccttgatttctcgtatggtaactgcctgatattatggtgggtcacaatatcaccttcttcctgattatttatatcaggatagtgatttacagcttttaaactgtgttcacatatagaatgtggttctcaaaataaccgtctcatgaggtactatattatctccactttacagatgcagaaactgacagattcaagtgccagcaagagccgaaacaagacttttccatttcccagtgtccagctcctggaacagcacactgtacagggattcatgcaggttgggggagctctagtgggtggggagtcagaactccagagcttcatacccatggagctccagctggtaggcggccatgtcggccacggcttgggcatcagcagctgaaccagagagtgcacagtagatgcgctcgtgcagcggggacagcttgtcaaacactcggttcaccaccgcctcgctgtcaggagggagtcaacagtcaccaagttaaaactcaggttttttttttttttttttttttttgagacagtctcactctgtcacccaggctggagtgcagtggatcaatcttgggctcactgcaaacttcgcctccctggttcaagtgattctcctgcctcagcctcccgaatagctgggattacaggcacccaccaccaagcccagctaatgtttgtattttcagtagagacaaggtcccaacatgttggccaggctggtctcaaactcctgacctcaaatatctgcccacctcggcatcccaaagtgctgagattatagatgtgagccactgcacccaaccagaactcaggaatttttgagggtgatcattcaatgtctctcaaatttctttgacaagagaatagcatgaagtttaatgcttggattaaagcaggaggcaaataatcatctcagatattattaatcactgcagatgttaatcaaaattaggcttatttttcaggcttagattttataacaaagcaaaaaatgctaaggtaagaaaaatatgcctcatcaattttctttgctattaacaatcttgagagagttatgttctatggaacataatgtcagtaatattgacctaaccccatatactcattttgcatgtgaggaaattggttaggagtgggagaagagacaaaatagttcaatatatggtaaatgagaaaccaggtatctgcttgacagaatcatctttttgatccctaagcacagatggaaagaagaccctcaaaaatctatctcctgtccccctctcagaccctattcctttactcatccctgtacactactgggacaggtcacatacacattcagaccccagatcctcctccacaaattcagagacccaagcacccaccaaatagcttatcatagtggcttttggggaaggtcaactccattcctccaaggctccagtttgccagtcttttcatgaatgggtaaggaaagtgtgtatttgaggccattagcttctttccaaatgcatacatcttcacttttactcaccctgcagacactcgggaatcagaacccatcacaacgcccccgtcaaactccactgccatgatggtggtctgcagagacacagaatatggaatgtcagggcaagaacagccttgatgccctcatgttagagaagaagaaacattcccagagaggcgaagtgactggctcaaagattacacagtaacaggccagagctgactgtcagtacaggctttttttcccttcatctttccactttctctattgcttcatccggctgcaggggaatgccacagcccagctgtgatacaacacagaaagaactgtgtccctaagttccaacttgcctagtggaatcctctccactgtagagaggtggagatgaggctcctacaggtagaagtgaagcagctccgcaagtgaaaattatctccaacggaagggctcatagtatgtgcagatgtggtgtagacccaacacagagtaattgactatgatcttgggaaacaaggtcagtctatttttttttttttggtccacaatcctccactctcaccccccatttcatcagaagtgagctcttccaatttactgaacattggaaaaaatcgaggagggcagtggttagcatggccaggggcaaggcaggagagaagcagcaaggaacacatacagatggttgaaaataaaagtttcagttatggaatttccgatcaagaggtaaatacatatctcagcagccagggaggtaaatttgtaccaagagataatttgactgagaagtttaagctgacttttccaggtcaagaaaagaatcaagaagaagtgagggaagataaagctacatttattctactattgagttggaaggagccttaaagatcctcggttcaaatgaggaaaccaagtcacagaaaatgcaaacgacttatgcaaagtcacacagagttaatagtagacctgggactaaaattcaggtctaactcttatcccttgtttccacttctacttcctacttgccactgctcatttggcagtgaggggagatttcccaaattataagtggtttcactgtgtctttcttaccaggccgtaagttactctggccccaaaggacgctcctctgagtatgctttccgacggaccgacttatcatgaatagagggtcaaagaacagggttaacttcaagttagaggctattcctctctaacaaagccgcccccaagccacgagtggtggcagtagtccagagcagaagccagccagccagtcttggggctgccatctgccccaggcgcccatcctaagcaaagtccccccagtgggcacatgggagtgggcagggaagacacagggaagggagtaaggcagcatctgggccaaggagaggccttcctgggtcaagctagggaagggcatcactagttaacacagaacgcccattatcagtgcttgggctaagagttgcccagtggcaagtttatcaaaagtctgtgtgatgagttggtccttctcaataagtgcctatatttccttctcccaagtgctgttctacttcacccagggcaccatttcctcatctctttgcaccatccccaaccccctttcttgatttaaccagcccccactgtccgggaccagagtgaaagcgaaagcgctttagagtagcttcccgttgacgcttccagctaagagtcaaagcacccgctttttccaccagcctcgcgtgcctgttcccttcacggacactctagacgacccccctcagaaaagaaatactctatgctcattgcgggttgcaagcgctggctgctacaggcgacctccctgcgctcccgttggtctctgcattcacttctccgcgcgcgcttccagggtcccctggccgctgcatctcctccacccctctgccaaccctcaagcccagacccattaccccggtgtggacttctcccgcccggggtaagtccccggttggtgctcccgcccgcagcatccctgcaaggcaccgctctcctcgccgcctggggcactggtttccaacctgggacagcgcacaacgcgcagccgacagccccgccccttcgcggcgccgccaggaggcgcctgggtgctgcggggctgctttgcgcgcggcgctaacgtgtgtagggcagatctgccccgagacaagtgacgaggcagccccgccctgaggctggggtgggaaaactggtgcaagtggaaaggcaggaggcagggagaggcgagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccaggcccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggtaaggggaacgcagggcaagaggggaggacacaaggggactgggacaggaatcaaaggtaattgtcagtaaggtagagtagcgtgggttctgggaaatgtggagcgggagaaggactcctagcgtgggtcttggaacaccacttcggtgtagaagaaacggcactggactggcgggggccagaggttctgggctccattgctgaccgggtcttgattctttgggccacgccggaagcggggaaatcctttgctctggggccgaagggcggggcatcctcatctctaacaggaggcttttctacttcatgatctccagccttcctaataaaatcctgaaagttctggtagagcaaccacagggtagtgagttccagggcagcctatttaggttcgggattgagacgtcagtgtttcctttctgctgatgccctccaggataatggtgagggggaggaggcgtggtggggccagtctgactggaactgacctacttagacttaatatttgtgcgtgacctctcttctctttctccaggggagatggccattccattctttacgggccgcctcactgactggattctacaagatggctcagccgataccttcactcgaaacttaactctcatgtccattctcaccatagccaggtctgggggctgaaaatggggcaccctgcaaatgagggagttggaagttggggctgctgtccgaaatgcacttatatggggatacctgggaccttcagtctgttccctgaacacaccctgatcccctttttttccgggttctttatagtgcagtgctggagttcgtgggtgacgggatctataacaacaccatgggccacgtgcacagccacttgcagggagaggtgtttggggctgtcctgcgccaggagacggagtttttccaacagaaccagacaggtttctcctgaaactctttcattatacgccatgtactgttcatatcctcatacatctgctttgatctcccccctccccgctctctctctctcacacacacatacacacattgttccttctcattcttgatataccctctccctgtctctctctctctgtctctgtctctctctctctctctctcacacacacacacacacaattgtttttctcattcttgatatacctcaggagcaaaatattgtcctccttaccttaagaaaaacctagagttttcatctagcattttcttataaatctattcctatgtatccttagatagaaaccatagaatttcaaacctggaaattttgagctcatagagaccaactgcctcatctgacagagaaggaaactgaggccaagaccctaaatgctgaaactgcacagttacatatggctagagacacacttggggttagaaccctggtctcttgagtgctccacagacttcggcatgctttctagcagcactagaagctgtacagttacatatggctagagatagacctggggttagaaccctagtcccagtgagtgctccacagactttggcatgcttcctagcagcaccctcctcctccatctctgttatgtgaccagtttaagctcttcctgcctgtgtgtatagcatgggacatacaggttctctagggaacagaaagctttcaggaaaatggaaattcacatgtgcattaatgactttataattaaaatgaaggtcaggcctttcctctttaacactcatcttccctgcactgagatttgcagacctctggagaaccctaaccttgtttcctgcagcctccttagaaccccatgttgacacccctgaccctggcatcctggctcattgttagttcgtctcatcacttggaacctgtctgattcacctcactctcttctccccaaccctgcaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccaggtatgttcatggagttggcccgctctacacagaccctcatctcccagacttggcagactcagttcctctcacattgctttcagtccagctttcctggcacccttactgattctccatcttcatggaacaccctgtccctgtggtccatgttcccaggttgctcaacattaacctccatactctctgggtcttcttttctagcttctccccacaatctgtctttaagaatttgatccccaacccgttctgagtcattttcctcttcctcgtatttctttagcatccaaggggcatagctgtgtctctttctcttttctccttttcctctgtctcttctcacctttaatttccaaataggtaactcaggtattagtgtccctgatggtttgccaacccgtgtgacatctcttgtccatgtatccacagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtgtgagcacctgaagatgaatacccattcccttgtccttaagatgccgtgactccattcccattcctatgaccctgctcccactccttctttactgggaaatggttggttcagtattttcgtcctagcaacctgaggctcaatgactctactcagtgtccctagccccctccctctctttaaagatgctaggtggcttcctttcagtatggtacataaaatccacccaaccatgtggattggagagatgcgtgtcttccagtcctagggccttcctttgcctctcaggggaagtgcagggcgccataaattcttgcacctgggactgcttcatgctggtaccttgtagatttgttagtgagagtgatgggaatagtggaagccagggatgagggacatctgtgatgcactggaaagagagctacgccagtgatccgaagatcctggcttgatgatgcaatttacttgtcttgtgatcatgacaacaaatttaccttctctgagactgtttcctctttatttatttatttgtttgtttgtttgtttatttttacttattattattatttttgagctggagtctcgctttgtcgcccaggctggagtgcagtggcgcgatctgggctcactgcaagctccgcctcccgggttcacgccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaattgcaggcatgagccactgcgcccgactggttgtttcctcatttttcaaaaatggagtgatataaccttctttataaggctcttcatgtattagctgacatcacatgaatgaaagccttttgtgaagagtaaaatgctccccagacaaggtgatagtggtgatggtggtgaagataactgtgacttgcatgatgtgcattgagtcagactccatggggtctctggttcattctcctgtctgcctattgagcctgccgatgtcacttaggagacagggacttgatatttccttcaggttaatgactgtggttctttgtgtcccctccagatttctctacctcagtccctttttttgtggtctctttatagatttcaggtatgctgctgaaagtgggaatcctctacattggtgggcagctggtgaccagtggggctgtaagcagtgggaaccttgtcacatttgttctctaccagatgcagttcacccaggctgtggaggtgaggtccctccaccttcactccccagtgtgattccttcctctggcccagcaccatctgtgtgatgtccttccattctttacccttcttgcttcacataatgctggcaagcagactacctcactttcactattcttacctccctctaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggtacaacctaccactccctgtattccactggccccaactgcaattctgccatcctaaattttcttcctgccttcagcctgcttactgccaagcatatatcctccctaaccctttaaaggcaatggtaggcatcatctgttccataaatcttccccaaactcaagaacccagtttgggcttccaaagagaatgagagaagaggtttcgaagagagtgctctcacgttccaaggaattgctgcagcaaaatctgtgtcttcggtcttccatctttccttttcctttgtaatttggaatgtgatttttccctttcctggtggtatctgacatcaagtgtgtggcatagtggtgctgggtctctgcccttgtctttgccgcttcttctatctctactccttggggaggcatcacccagaaatctgtgcatgtgggagggtaggagtttctatatttccctgtttttcttctggggtaagacatcatgctatgtaacaaggcaatgacactctcaaggttagaggccttggtagcctcttatcgtgtgcttctctggcctctaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtatggaagcaggtggcttgaaggagggcagggagcatcaaatacgaagagcattcttactgagcactctgaaagaggggttagggaatgataagagaccttgggtggagatggtggtgtagtcaggagggaggtagtatgattttgtgacatgttctcaataaagattttgagtcttcgatctctagataaccatactcccatgtgccttgttctatgactcttcatcatatttcatctcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacaggtactctctccactcatctcaccacccagccatctttacctttgctgaaaccccagtagtcttgcctttatccttcagttcctccttactcatggacatcaatttgaagttgtaagatcatgctcctatggcttcttcatcctgacatcctcaggattctgttcatcttcccagaatctcccctatccagctacaaccgtcagatcttggtgtgtgtgagtgcgtgaatgcatgagtgtgtctgtgtgcatgtacatgcgtgcacacatgtggctataccgttctcatcttggccctttgctctgcagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtgaggcagtcatcttcttaatggctatatcccacccaatcttgcttcttttatacatcttctgttagttttactaacatcataattatacaaaccagtccttgcagttctcagttcccaaatccagttccattggatgcctccccaaggagtagagatagaagacgaggcaaagacacctagaatcagttaaaagagactatctacaaactacagactgaatttctttctttctttccttttttttttttaagacagtgtctcactcagttgcccaggctggagcgcagtggcacaatcttggctcactgcagcttcaacctgctgggctcaagcgattctcccctcagcctcccgagtagctgggactacaggtgtacaccactatgcctggttgacttttatatttttagtagagatgggtttcaccatgttgcccaggctggccttgaattcctgagctcaggtaatctgcccccctcagcctcccaaagggctggggttataggtgtgagccactgcgcccagtcctatagactgaatttctaaagcgaaacataaggaaaagaccatcctcataatatcgtttatttaaaaaaattattttttgtacagacagcgtcccgctatgttgcccaggctggccttgaactcctgggcccaagtgatcctccctccttgacctcccaaagtgctaggattataggcatgagccaccgggcccagcccatcctaatcatattaatattaattaagctagtctgtttacatgcactgtcactcatttattcattaggaatccttctgagctaggcatttatcatcattctacagatgacaaaatggaggttaaaagaggttgaataagctgctcatatagaggtcatatagcttttgagtggcgcagccttgacccaaattcaggtctgcctgacttgaatgctcatctctttactactaagttatatttccttaaaatcgaatataaaaatgccaagtccatgggtagagaagaggactattcaatagtctttattcttctgtcacgtgtttcaccctagggttctcatttttatcctacttttgcacccttcatgtaaaacagtccttaatgaaacaaagggtttgcggagaagtactcagaatgggaaacgttggtgtccttggggttgttagcagagccagcagtgatcctgtgaggtcagtcccagccctggaaacacaggtgtctccctgggctgagggtagtccccggctctgacggtccgatgtctttcctcaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgtactgtggtttcttatgtttccggcacaccaaacggcccactgccttttgcagcgcacttttcagctgcggatgtctcctcttttatcatcctcaatgttttaccccctaactgcatcaccttttcccttaagctttttaattcctatgaggccccttccacttcccctatccccttaggcccacccccaagaatgtgcaagaccccagccacagggcccatcagggcactagcggccgcagctcagagccgtggcctctccgaagtggcagatggggcgggcgcggccagagcaagtgccaggcgggaacagagggactgggcgcgcctcacaactcaccacctcgcccgctggtccttcctggctcgcctggctctgaagctgcacctggaggggaaacctcagaacagtaggcgggattgcctagtaaatatctcccattcagggaggcccaggtcgtgtgacgtcgacagttgctgggtagatgaggccaacacaggttgcaagaagaggcggggtttagaggcgtgaaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggaggtacctcttactgtaacccatcgccaagtgggcttttgaaggcgcctgttcctttctcgctttcttcggaagacccttgacccatcattcccccgacccccataacgggagagcagagaagccggtccccagtgtgatggtcctggtccaggcactaactgtccttttctcggaaaaggcagggggatgtggaaaagagtcttgttccctccccttcgatctgtggctttcgctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcaggtcggggcagtagggaagcccctagggatgcagggaggcgggcgctgaggagtggagggtcgcctgagaggaggaggcgagagcgggagcgcggggtacagggtcgggggtagccttcagtcccggagagcgccagacccaaagaagaggccacatggggatggggcctgagaggaggaagtgcaagttaggacaaagagttacaggtgaggtgggggctcccaaaggaagacaagagaactttcctgcccttgtccacacacaaatggtggagcctttttcatggggttatcacatgatataggaggtgtgtggtgtcttgggaaacctatgaaatttgcctgctggcctcctctcagcaactcactgttgcgcgacttagaacaagtcacttagtctaggtcccaagcccctcttctgtaaagtgaggatactgttactaaacgtgttttgtgagggttgaatgctttatgcatggaagaaaccctttaagtcactctcaaaattttttagtaatggtaacatgtgcttgctttcatttctgttgtgctggaaaatggaaaaggttgatactggcatgcctcttcttttccttctcccaagccatttccttctagagattggttattaactgtttcatttattgatggttagatcatttctgcatatctcctcaccctcatactccctaaaaccttttcctggagcctcttactacagaatttttcattgcctttctcaacctcttttctcttatcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgagtgtatacgctccagcaggcagaatctggggagctgggctctcctttccacaggaggccaactctgcaacaaagtggaagtggatattgatttaggacacactgggggatctatggggtcatcccttctctcccaaagctccatcttcttccaggtgccttacgggtgaacaaggtgattgagattaacccttacctgcttggcaccatgtctggctgtgcagcagactgtcagtactgggagcgcctgctggccaaggaatgcaggtaagcgaggcctctcatcttcctttcttagcctagtggttaatccctggatctctcagatcattgctccttactcttgtcctatgtggtccatcttagtgctaatagtatatttcacaaaacagctttttggtgataagacccttctcccaaatctcagcctgtgctccactcataagccagatagtacgtcaggtatttagcactgacacatccaccctggcgggacagtatcatttactaggctgcctttgtatgtttcagatactttaaattccaaatctttctctgatctttagatcctacaaaataattcctttccaatgcttatctctttaatcatttcctgccccatcaagttggaaagagctaacctctctttcctcactccaccttgtcctcacccaggctgtactatctgcgaaatggagaacgtatttcagtgtcggcagcctccaagctgctgtccaacatgatgtgccagtaccggggcatgggcctctctatgggcagtatgatctgtggctgggataagaaggtgggtgctctccattcttcatgttcccccaccatgttccctatggatgacagatctgtttcccatcatatactcctactccctccctgacaagatgcatggcatatagagtgcttggttatagaactgtttcagtatatccatggactatttattggcccagatatgaatcattgcatgtgttttgtaagcttgtcccttttgttaaacagttgatttcaagtttgtttttcctttttcatttctaaagttcgatgactttaccaaagtggtttcctaattccaatgttcttgtggtaatattaattcttttgttcactttttatgtctcatatttgaacccccatgttaccaacatcttcctctccaatttcagcctgaaatctttcatcttatagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatagtaagagaccaatgctcccaccaccatgcctgggaggagtcggcgggtggtggggggggtgatttaagattgagaaaccagcctggccaacatggcgaaaccccgtctctactaaaactacaaaaattagccggacgtggtgacgggtgcctgtagtcccagctacttgggaggctgaggcaggagaatcacttgaacctgggaggtggagcttgcagtgagccaagatggcgccactgcattccagtctgggccacagagtgagactccttctcaaaagaaaaaaaagaaaatgattgagagactcaaaggagggagagtagtagggaggaaattttcagagtcagaagaagggcattaaaggcccagtcatatggttttaagcttgcgcatgtgtcttgttgctgccttcaacataacatcagtgacaggaacttgctgaggtgaaaggtgactccatgttcttttctcatttgtccacagtgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaatacctctgtcttgtggctgaatggggttgggcctgtggttgttgggtggggcagaaagtaaagagacgctttttctggagaaggggctcagacccctatctaagaaatgtggcctcaccacatagttcttcctggggtttccttccacactcatctctccaagacctcaggaaggctgctcattgctgtccatggacacttgtttgcaatttcacataggttagggtcctttccatagagaggcacctggggactcctgtgtgttccattgttaatggtttgaggaacagggagtagggcacctaggataactgtttttgactttatagagtaggatgaaaaagcttccacttcactttaatatggtaatcatataaacaccataccatttatcccaaataacactttggagatattggatattgaatataaagacagacattaagggtctaatttcatgatgtgtcatgctgaattgcaagatggcaggactataattttagaggaagaagagatcaggaggactcccctaagtgaggagtgtggggaaaatgtaaaagatccaggttagaagaaagagacacacatcatgagattttcggaatcatgctggaactatggaccatgtcactttccagaaaataaaggaaacaaatgcttgaaagtaggagcatgagcttgagcatggagcttttttcattagagagagattcttaaaatgccagaatgaatagagttgtaaaactttagcgagcccctacttaaaatccctcctccccaccaccactattttaaactttaagtgactccttggtagtcacacaggtaacatttcaaaatggtgatctggaatccaagcgacccttcctttggggaatttgtttgtttgtttgtttttagtttgggaggtggtttcaatctgaagagtcctttctggaataaacgaatctttctgttgcataggaaggctctgggtcaggaaggatatttaaaaacctaattactgttctaaacagtgttaaaatagaacaagaaccaaagctcagtacggggcatttccctcataggctgaaggtgcgcccaacataatttggagtacagactcagaggcacctgaacacgcgccagctcaaggtgctccggctgagaaggacggatgaagatgaacgctcagggcctactaaattcaaagtctgtacgtgaaaatcccctttggcctggtgagattggttggaaccttctatttaggagagcccggctcgctcgcctaaaactggagcttgcatggaagagggcacttttttttttttagacgaagtctcactcttgtcgcccaggctggagtgcaatgacccgatctcggctcactgaaacctctgcctcctgagttcaagcgattcccctgcctcagcctcccgagtagctgggattacaggcgtccgccaccacgccctggctaatttttgtatttttagtagagacagggtttcaccatgttggccaggctggtctcgaacccctgacctcaggcgatccgcccgcctcggcctcccaaagtgctgtgattacaggcgtgagccaccgcgccggaccagaaagaaggcacttcttaatagtaggctcagagcttgaagtagtaactttgagaaaattcagtgattctccaattacaaagcattctccaattacaaagcaaggacaacagataaagttgcccttgagacaactgtattttacttaatgataaagaaacatttttgcagttttatatcccagagtaaccgccactaaaggcgagtgagactcattgcaggcctgtacagtgcgaaccagagttcgggctccagttccgctgtctgcgggtctcgcgcgccccctcccggcggcccagcccagaatgaaggccttggctggggaagcgaaagcgaaagctgcccgagccctgacgcccgccctggccgagcgtagctggcggaccagagccggtagcgaggttgggagagacggagcggacctcagcgctgaagcagaagtccccggagctgcggtctccccgccgcggctggtgagttggtgcggaggggaacctggagcgccaacagggacgcagcccaagtgactacccactccacgctcctgcttcccagtccctctgcacccggcgataggagggagcggagcccggaccacttagctcgccgcggcaggcgggggtgggggtgggggtccggggattttttttttttttttttttaagcacgaggctcctgatggtcatgcttccagctccccagaaggccgaaagctgtctgtcgtaggaggggtgtacggatgagcaccggttactcaggagagctctcagggttgaataggataaaatgagaagccgatggacgggttaggcggagccgggcgggtaggagggcagggacaaggattgggactccacccccatgatttctcatctcgtatccgttgacagagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagtcaggagaggacgttgtgagttggaggtggtaaaagggcctgggcaccagcacattcttgtgttatttttcatgcctctttcaggtgagacattaatccctcactattctggtcgtgtgattgacatcctgggaggtgattttgacccccatgcctttgccagtgccatcttcttcatgtgcctcttctcctttggcaggtaggtggtgggcagctgggtccatttgctagccccaaatctttataggggtcttcacttccctaactccatttctaggccctttcaggcgcaaaacacaaaaatacttaaactaaaatatggtgaatgtagtcaccattctgtttcatctatccattcatttcttccttcgttcatattcatccaatatcttcaaagtttatctgatcttattataggaacaagttatgagtgaaggtagtacaaaaggaatttaagtctcagatggaatgtctctcagttgtctctcaacattcctaggtccatgaaattccatttctttctgcctcctacctcctacccctaagtctgtctccaaagtatctctccagggtcactctctcaggatgggtatgcttctccctctcactcttctttcccagctcatcttgctaatccctgaagatcttactctgaggcttatcacctttctttccagaatcattactcttttcccttcacttgctttcctttctctttctagacatactcaaacaaacaaactgtttgataaggctgggactgggatgaggtgagcgaggcacctggggtgcaaagtttaaggaggtgtgcactcaccttacccaaatcccagccggcctgattgtctctatttttatggtcatacttaatttagagtaccctcgaaaaccatttcattgtgccttcattccatcctggctgctttctgctgaaactacagtcgtgcactgcataacgatgtttaggtcaatgatgggccacatataagatggtggacccacaagattataataccatatttttactgtaccttttctatgtttagatacacaaatacttacttctgtgttacagtcgcccacagtgttaggtgcagtcatatgttgtacagatttgtagcctaggagcaataggctaaactacatggcctaggtgtgcagtaggctatgacatctaggtttgtgtaagtacactctatgatgttcatacaacgatgaaaccatctaacgacacatttctcagaacacatccctgtcattaaagtacaaaccctcattatatcatgtctgactattccaaacgcctcttcaatatggtaactaaatttgtattagaaacatatattttgtaaaatacatgcttttatgctttatattttttcctctaagtgttactgtagcatgtagttggtctaagagggattttccaactcgaaggatgacagatgggaatcacatgactctggggctccagagaattgtgggggcagggaatttattattgcagttcccatgatgaagtatctatgatgacagagaagggctttgggtatggggcaggaaggagaccaaggcggaggagacgcacagagggacaagcctgagggacgctgggacagaagcaagcactgggatacttgttttcacaatatcttttcccttctattgtagttttctattgtgtctagtacagagtgcactccataaatacttgtaaatttgtacatgttatgattttgttctcacatctagctcaccatgtctcctctttcttcttcctctgtgtattccttacctcttctctctctgtgtgtctgtctctcatttctttctcttttgcccctcctggcatgctttcccctgactttgcgcttctctgcactcctggcttgctcctctgtttcacccgctggcttgctccttctctgcatctccctcccctcttattctcctaccccacagctcactgtctgcaggctgccgaggaggctgcttcacctacaccatgtctcgaatcaacttgcggatccgggagcagcttttctcctccctgctgcgccaggacctcggtttcttccaggagactaagacaggtggggcctggagtccaggtctgagattcccatggacatcccttgcccctcagtgaccttccacccacagcctctcctcctgccttcacccgtatgccaggacctggggatgcttttctcttgtttgggacagggtggagaagcagcctccactgtccctctgcaagtgaaggaggatgttcagaggagggggctgtgtcagagggaacggtcaggagggagtttctgggggccctgcagtacacatggtttcctttttcctcacctgctctgtccttcttaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggtgagcgtgcatgtaagggaaccccaaagggagaataaaactgacaggtgaggaggcttccacatttgtggctagaggatcccctagagagagatgttctcttctcagccattaggggagaaggtatattgtagtatatactacattttgtttgtccagccatccaacaatggatatttgacttcagaagattcatgattctccagaactgtaaacaaaaatgtaaagtgtatgtgaaggtatgggggagggaataggaaggggagatgataggcgatgataacttttcattagcttctcaaaggagtctgtacatcccccgcccccactgcgaagattaaaaatggtttcttagaggcttttaggcagggagattttccctttaaaatcagcagaagaagtctggatgcagcatagggaaaggaggcgtcatcaggaagtcctaagtctgaatgtcagctccaccttctctttttctcttatattgtggtaaaacatacataacataaaatttaccatttcaaccatttgaagtgtacagttcagtgacatttaggaaacccacattgttattgggtagccatcatcaccatccatctccagaacttttttcatcttcctaaaatgaaactctgtacccactaaatagtaactgcctactacccccaacccctggccgctggcaacctccattgtaccttctgtctccatgaattgtgatgactcccggtgcggtacgtaagtggaaccatacagtatttgtctttttgtgactggcatattttacttagcgtaatgtcttcaggcctcatccatattgtagcatgtgttagaatttcctcccttttaaggctgaataatattctgttgtgtgcatatatcacattttgattatccattcatctgtcaatggacatttgcgttgtttccaccttttggctgttgtgaattatgctgctgtggacatgagtgtacacctgtttgaaaccctgcttttggttcttttgggtatatacttagaagtggagctgctggatcatatggcaattctatttaacaatttttgaggaaccatgtattagtccatttttacgctgctgataaagacatacccaagattgggcaatttacaaaagaaagaggtttattggacttacagttccatgtggctgggaagacctcaaatcatggcggaaggtgaaagacacatttcacatggcagcagacaagagaaaagacagcttgtgcaggggaattcccctttttaaaaccattatatctcgtgagacttattcaatatcacaagaacagcatgggaaagacttgccctcatgattcaattacctcctacccagtccctcccacaacacatgggaattcaagatcagatatgggtagggacacagccagatcgtatcaaaccaccatacagttttccatagcggcagcaccattttaaattcccaccagcagtgcataaggtttccaatttctccacatcctcatcaacaccactttctgttgtctttttttttaatagccattctaatggtgattaggtgattaggattatctcattgtggttttgatttgcatttccctaatgattagtaaatattgagcatcttttcgtgtgattttggccacttatgtttctttcttgaaagaatgtctgcaagttctttgcccattttctgatttttttttaagttgtgggagttcactatatgttttgcctattaatttcctatcagatatatgattcacaaatattttcttgtatttcatggttgctttttcactctgttgctagagttctttgatgcacaaacgttttaaattctgatgaagtctgatttatctattttttgttgcctgtgcgtttggtgttatatccaagaaatcactgccaaatctagtggcatgaggcttttcttctacattttcctaggagttttatagtgttagctcttatgtttaggcctctgatccatttggaattacatctccacctttcttaactatctgtggctccttgggaaaactacccttctttcctgattcagacactggggatgggaaaattacctcaaatgaaggttaaaaaaattgcatgtatctcctatactacctaacactgagagctcaataatattttgttcccttgctccttcactcttattccttctggaaagaagagtaaggaagagggagagaaacagtttggtatttttaggtagactagggagcatctcactggctggagtaagatgtgggggcctgctgtctttgcacatcagccctggtgtttgctggccctcttttccaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtaagataccagagtggttgtgaaaggagcccaggaaagggggagggcaagggaagaggaaactacagctggttctagaggcctttgcagctcagtctcatagaggcagagagggggaaagaatgggaagattcccagcctcatctctttcttctcctcttccaggtgctgcacttgggggtgcagatgctgatgctgagctgtgggctgcagcagatgcaggatggggagctcacccagggcagcctgctttcctttatgatctaccaggagagcgtggggagctatgtgcaggtgagcgagaagccaagcctgctctccttttttccctctctttttctttgtggactcctgggccttgggctttatttgttctttttaacaatacaatacaaaaccaaaacccgcaagtaattttgctatggagaattttaaacatatgccaaaaatgagacaaaataatattacaaactcacatgtatacatcctgtgctttaacaatgatcaactcatgcccaatcttgttggatctgtatccccagccacttccccccacccatattattctgaagcaaatccaagatattgtatactttcatctgtaaatatttcagtatgtttcttaaaaatacaaacatctttaaaagtgtataacaacaaagccattatcacaccaaaaaattaacagtagttcttaaaatttatcaaatagtcaattgtcaaatttccacttgtggtatccatgtagtatatgtgtatgagtgtgtttattatactttgcttaaatcaggatccagaaatggtccacatattgtgactggttgatacatcttttaagtctgtctgtctatctatctatccatccatctatccatccatccacccatcaatccatgtatctgtctaaaagtttcccttgcacagtttatttgttgaagaaataggttgtttgtcctgtggagtttcttagggtctggattttgttgactgaatccctgtggtattatatgctcttctgcctctgtacttcctgtctattgatagataaacctagaagcttgtgagattgaggggttttttttggtctttttccagcaacagtactttttaggtggtgatgcattcttcctccaagaggcacacaatgtctggttctctatttgtggcaacatcagccactgatgagcagtacctacatccatgacagaattagggctgcaaaagggagatactctatcattcttcatgtattagctgaagtagtctatgaagggagacttcccctcatctaccatttcattacccggtggtacagtttgatgaggaaaggcagagtgagcatttagatctcttcctacatttaccagttctcaaaaacagctacttcatccagggctttatttaaacattttcctagacacttgataaacatcttttttgtgtagagaactgcgctgggcactctgacggctacaaaggtgagttgggcacagtgcctgcatttaaggagctccccgtctaatcaagcaagacagaactgggcacaagtaataggaagcagtaactgaaaagatctggggctagaggcaatgctgtatggtaggagaagggactgtatatcctttatattgcaaattggaacactggggtattggtgccacttttaaattccgtccaaattgtacatttaaaagtggagaatctcttttgagtatggaggaggagcagtgcagttgtgagtggagtgtgtgaggagttgggagggtggtttctggtagaagtgtgtttaattagccggctctcccattcctgttttccagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggtgcctgaaagagggaggaaacctggacccttgctctctgctgctaatgcataattggacatcacagcctatagttcatttgcctctgagaacctggtcttgcctctgctaagaagagaaatggagggattttgagggagaaggggcaggcccttaactctttttctggttttctaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtgggtgaggagggagaagacaggggacaggagaggggagcatgtacagagagaggatgggagatccacgggaaggcgcaccaggtgttcattctgagggaggtaggtggggaggacaaaagggcccctgccttgggggtttacacatagtcctctgcccctgtccctgctgcacaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacaggtatcttctacaaattgtaagcttgctccttcagtaaaaaagagaaaatcagacttactcttagtggtgaaggtcgtgtccctgtagcttgatgtttgctgttcctctgccctttcctccattcctacgtctccttccccacacactgaattcttcagcctccctcttgatcaagagtctttgtttgcagagagcaatgcagcagtggtgctccctccatgggcagccccgtcaggtccccaccccatggccctcctcccactgggccctccccgcactgggccctcccacctcccgaggtcctactggaagtacctgctgtgcacttgtccctccttgtgtgttgtctgtgtcacttgtatctgaggaagggaatttctctgatttcctcagatgtaggggagaagggaagccagctggctgcgggacagaaacaacgtctggccattgcccgggcccttgtacgagacccgcgggtcctcatcctggatgaggctactagtgccctagatgtgcagtgcgagcaggccgtgagtaccgtgagagggcaggggacagtggggcctgggaggggcatgctgggaggatcagactgtgcagaattgggcagagggaggacgaaggacctactagtggaaacagtctgtgccttcttggggttggggaatggaatccggtggtgtgagggcagccccagttccctcctgggcttccattcctccagctgtggcagtacagccgggagagaagggcagtccaggcctttatctactgccctttcctaccttcttttatttcacaccttctttaccctaaatcataagagatggtgcccaggtggatgtggtgtccatctcattcctgtctttctgaggcactgtgatcaccccttcagctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaactttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggagtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactcctactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattctattttatggaagttccatatttcatttatcctgtttccttctactgatggctagttaggttattggaagtcttttgctgttgctagttagtcttgtatagacattgtaatgcacatgtgcaaaaatacaagtatgatacaatcttaaaggggagttgctgagtccaatatatacattacaaatattgatagatattgcaaaattgccttcatagaggctgtattaatttatagttccagcagcaacatatgagtttatctgtttctccatatatatatatatgtatataaccaacagacagtgttaatttttaaaattttgacaatcttctgggtgaaagtagcattgtattgtagttatcatttgctttttaatattatcatgtaagtaacagagatactaaacccagaaggataagggagcaaagatgagaaaaataaacacacacacaaacaacaataacaaatctgtctaaaatattggaaaatcagaatgagaaatgaaatatgactgtaacgataaaaatcagtaataaaaatgactattaaatttaaaaataaggcagagcaaccacaagtgacatgagaatgaggcagacaaagttaaagcacctaaagtctttgtcttgtttgaaaggagggtagagatattgattaccttcagatgctgccacatttggtaaacatgttaaaaatataagactgacttttaactaatataattagaatttaaaattcctaaatcagtaaggggaaattaaataatactttaaataaaaatgtaattgatttaatataagtgatgcaaggaaaacaaaagaagcaaagtaagacatagcaaatacagagcaccatatattgtaacagaaacgaatgtaaatagcacagtgatcacaagtataaatagcttaaatatgggagttaaaggaaagttctcagattagattaacaatatcgcaaaatccagttatatgcccttcataagatcacaagaaacctaaaaacatgaaaatgttaaatcaaaaccagatataagatacacaaagcaaacactaacagaagacagaaagacagcttatgtaattacagaaatatctaaacatatagtctaaaaccaaaggcattagtaaaaacaaagacagccattacatagtgataatgaagtcaccagaacattatactaaaactgaatcagtttgcacctagcaataaaactacaaaatatgtaagaaatataggagaattataggaagaaattaattgagaaattgaaacacatttctcaatgattatagaataagtggaaaaatgaataaggatatcaaataagcctgttgatgttcttgtctgtaacatctaggaatcaaaatatattctttaaaactaataaatcaagtgctcgtatttacacatttaagactacaaaggtagacacacacacagaaagaggaagggagaggatatgagctagttttgtgattgttcattatttaaaactaataggaattatctaaaggaagagggaactaagtgtattatatacaaataaacttatcaaagcaaccttgaaatatacaccttccttaatatctgaaaaggtaaaatttttaaaatgcacaataaagacatagtgaaagatttttaaaaatactcatgtaaacattatacttaacagaagttaatatctctgaattagactgaatctatttgctgtatgaataattataaatgggcttcttaactgaactaaataaatgaaaatatttttaaattagattaagataaaaactctattatttgcaatatgcaaaagacacctaacataaagccactcagaaagatgtattcattattttcaacaaataagatgatgggcaaagacataacaagagaaggcaaacaaaagggaagcagaggtcacattcgtcttaccaaacaagatgaaattcagacactcctcaccaaaaaaaaaaaaaaaaaaaaaaaattgagtgtgacagaggcacttataatgtaaagtataaaattcatatgaatatatgagacatgtgtttaagttctaaataccaaataggtagctcttataaagcagaaattaaggtagatacaaggaaaatattcagaaatgtactaccaatagaacactttaattccctttccctggactagaccagttaagtggacaaaaaaataggctgggcctggtgattcatgcctgtaatctcagcactttggtaggccaaggcgggtggatcacctgaggtcaggatttcgagggcagcctggccaacatggtgaaaccctgtctctaccaaaaatacaaaaattagctgggtgtggtggtgggcgcctgtaatcccagctacttgggaggccgaggcaggagaattgcttgaatctgggaggcaaaggttgtagcgagccaagatcgcaccactgcactccagcctgggcggcacagtgagactctgcctcaaaaaaaaaaaaaaaaaaaagtatgaacacagaagatagaagatattactatcaataaaaaaatagatatgctacatctatatcaaacttttaaaattgaaaatagaggccgggtgcagtggctcacacctataatcccagcactttgggaggcctaagcagtcggattgcttgaactcaggagctcaagaccagtgtgggcaacagcgaaaacccgtctctacaaaaaatacaaaaattagccagatgtggtggctcgtgcctgtggtttcaactacttggctgaggtgggaggatcgcttgggcccagttcaaggctgcagtgagctatgattgtgccactgcactccagcctgggcaacagagtgaggccttgtctctaaaacaaacaaacaaacaaacaaaaattaaatggctcaatggcatagaagaaaatttttttatgaagcaagtataatattgatgttaaactatgacaatgcacaaatataaaaattgtagatgaatttacttattatactgacacaaaaatcctaaataaaacattgcaaacagattctagcacagattaaaaaacacccattaagatcaaggggttttttttgttttttttttctagaaaaccctttggaagttcatgatattttgaatttcagtggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaacaatgtgttctctaaaagtatgatttaatattctacctagaaactcagaatatttttcataactcctccagggcagtgtggattatgttgatgtgttaggaggaagtagaaggaagaaaatgaattgagatgtacgttttacttccatgtcaaagtcaccaaaatagcagttgaagggatatttgtgtcaggcaatagggagaataataattttatgccaccctcaaaaaacaaccacacatacacccaaattctctcactcctcagagaaaggggaaggaaagaaaagagagaagcaaaatatgagcttgagtgaaaaatcacagaggagcctgtagctatttagggagggctgctggctgaagtcaggcaggaaaaaaagatcaaaacaccctgccctatttttcaggctcgttcaagtagaagacaaaaacataaatacaggagaaaggaagaaaaccacatctttttcctcttgtctccccagaactgaacagtgtctctgataagcccaggcccttctatcgtagacactgacactatgcacagaaaatgactcaaaaacgcttctaatgggggtgaatctgatgcttcagtttatttaagatgtaccagaggccatctaaggagatccatagcttgctaactgaagcttattgctttctcttcttagttcccatgccaggctctatgccattccttgcttgtcatgtgagatcactgatttcctttggttaggtaggatatgatttccttacagagatctgtcctgacaccaaacagctatgatgaaattccttggttattttccctttttgtgtaccttatcattaccggaatgctaaagctgtaggaataaagtttccctggcttcccaagaaatacagtgtgacagaaaaagtatagcctagggacttactagttatgtgaactttggttcattccatccttacctcatctgtaaaagggagatcatgatagtatctactgcaaagggttttgtgtgatgattctctctctttctctctctctcatacacacacacgcacacatttatataatgcttagaaaatgaactcataataagcaattgacaaacattagctattattatgtaggcaagtcagattttagagtttgtgagccttagacacatttacagagaagaaagagcagccctcctaactttctggtccagcgccatatcctccacttcctccccatccccacatcccttgccatttatcaaccccctctctcctctaaatctaaatacaggcccccgtttgatccatattgtctaggcccttcctctcctctccacatggcccttccttcagctctgagggaagctgcagaagccagccatggtgctgtctacaaagaaggggacacacgcctcttccacccgctcatgctgttactgcatctgatcatctccgtgccgtgtccttgttcacttagcctgtgttgagtgtttgtctccatttccaaatgcaataaaacatctgggaaagactaaggtaggtgtgggcaggaagaagggaggaagttagacccagtggcttgagtgccctctgatgcctccttatcctcggctccacacaagccctcgccagtgtgagctccacagccatccacctggaggaggagtactcaaaaccagggtcaaatgccttgtactcgggggtctaccagtaagcctgtggccagccttccacttcatgaatcgtcacatttacatgagagatgtggagggagaggggtcagcctcctagctcctgtcctgtagcagttaagtcaagtcaggccaggctgtggtaaccaagccagtaccttctttaaagaacagttgtttctcattcatacagagtgtgttgtaggtgtgagtgattccctggggcagctgctcttcatggtgactcagctaattagactgcttttctactgggattgtgccatctcaacacaaggctgtcttggttgacttggtaggggaggaggagaagagtcatgcacgaggagttaaattctttgaccaggaaccttttgttcactttccattggtgagaacgagtcacacagctccaggagagtaggaagtctagtttctcgttttccatgggcctaggaattagaggatgaacactagcgatgtcttccacgtcttgctctctttttctttacctgttataatctcccatggagaagaaattatttttctgattggtctgatccaggcctctaaccaagggcatttactaagggtcatagaacagtaaaaggttgcacaattgcatctcacctctcttttctgaatcctgcttaattaaaactttaaaaactcacttacagaccacttcttgctcttcttagttatcaaatatattttcttccaactcctttttgacagatcttgccttgttctcagctgactcccttgcaaccatctaaatggaacttcctcattcccctttatcccctgctaatcgtcctgtctttattcttttatctgaagaagtgtacccttcttcccccaagccttatgctctctgtcttagtccatttgtgttagtgtaacaagatacacgagatagggtaatttatgaagaacagaaatttatttctcacagttctggaagctagaagttcaaggtcatggccctggaagatttgatgccttggccatcgacttgaaaaaagtcactgaagtgaacttgtggttaccatgataccctgggttcattcttaacatgcacagtataggcaaatcaggggcacatttcatgctgaaagatgatgtgaaatgatgagtaaacattgccctttaaataataataacatagatggtgaattacaatttgcacttttggttttatttgcttaaagatagtgttttactgtctaggttttactgaaagaatacttaactaaacacttgagtcaaatcattccagtgtaacagtcctcacaaggaggaaggcagaagggcaaaagtgccaagctattgcctccagcccttctatttttattgattgactgattgattgattgagacagggcctcgttctgttacccatgctggagtacagtggtgcattcatggttcactgcaactttgaacttctgggctcaagtagtcttcccacctcagcctccaaagtaactaagaccacaggtgcatgccaccatgtttatttctttaattttttaaattttatttggacatgggggtctcactatgttttccaggcaggtctctaactcctagcctcaagcaatcttcctcctcagcctcccaaagtgctgggattacaggcatgagccatcatccctgctctctctagccctttttaaagtctctaatcccattcaggaggcctctgcattcatgacttaatcacctcctaaagggcccaccttttgatactatcacattggtgattaaattgcaacacttgaattttgagtgacattcagaccacagcattttggagaaaatgtcccctttcttctcttttttctcttcagtttctcctttctacagataccttgcacttcacttgcaaccttgttgaagtctctcctgtcttaaaagtttcttttcccaaaacaccagaactcattccttctgtctaactgtaactttgtacttgttaccaacctctacccatttctacccctgactccccagcctctggtaactcctaacgtactctttacttcgatgaggtcaacttttttagattccacatatgagtgaaatcacgtaatatagtccttctgttcttggcttatttcacttaacatagagccctccaggttcacccatgttgttgaaaatgacaggatttcatgcttttttatggcggaatagtattccatcatgtatatatatcacatactaattaccctgatttgatcaatacacaatgtataggtgtgttggaacatcatgctgtaccccataaatatgtacaattattacgtgtcaatttaaaaaacccaagaaaagtattttttcttagtgttgtttttttctaaagtgtatcccattttttcctttgttttcactttcaaaattcttgaaagactattttaatctgcggcctttgttttcttgtttccaattcattcttttgaaatatggcttctacctttaacactctgctgtcctcttgaaggttattggtgccctactaaccataaaacacaataatgctctcttagattgtatcctggtgagcctttttgcaaaattttattctttgagaattctctttccatgttttcttttcttttctttttttgtggtcattttggcttataggaaatcgtactctccaaatgttctctatgtcttctatttcttctctgataatccctttactaaatcttcttgaggcatatgcttcagaatgcttaatttacatactcttaattccttcttaatttacacactgcctgtcggcaatgtcaacacccaataagaagggagacctattggtcagaacaggccagggaatagaagaatacataataaacagtctgcctagttcttctagggccccataatatgtcaaacatatatttttacttcttctcccagcccatttttagtatacctaaattactgtcagtgattctgcaggcaaacaatggttgagttgtatgacacaactttgtgaaagtatcctacccagtacctgatgatgcaaaactcttctatcttgattggttgtcaatctgaggagtttccaatcctggggaagccagaaaaacagcgatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccaggtaagaacagagcaattgtttttttccagtgtgtatgcaagaattggcatgggggagtgatgcctttctttgtaagtccaggccacagaccagactggaagtggcttttggtttcaaagaacagtgttcttccctttggcagaaaggtacgccttgcctctttacatgggatggacttcatataccagagccacctattcaaggggtagggaggcaggaagagggaaacattgtgtcttgtttaggatccttattgtgtatcaacctcagtcagtacctaggcgtgttgaaggcctggcttgggttcgagcctgctgggagaaacaacctgcagtaggctgggtcacagaggcaatctgtgattttttggtcaggacacggaaacaaatctcagttggggtatatgtggacaaatgaaactggaaacaaaggttgctccttctgtcatttattaagccactattatattgtcagaattgtactaaacagttttgagaagtaagagaagttgaatagaatacattgtccttgtcctccgcacnaggtacaagttacttgtcactgttatttttcagcacaggtgacagaatatgcagccatgagcaatgtgagatgaagcacatattaatgagcagaaacaggatgtaatgtgctaagaacagaatcccctttgcatgttagtttcattaaatacaaaagaggaatcaaacctggccaggagagatcattattcttagagaatagaaaccgccctgagtttataatgtccattaaacaatacaactgaaaaaaaaatcagcacagatgttaaatgatgatgaaaaattcagatttcccccctagtttagactactagaggaaatagagaagagtatacatgctgagaaattacaggctggaacttcatctgaaattagctactgagtgagggataagtggggttcacctaggaaggtcattcttatggctcagttggaggcttcgaacttagaaaggaaaggtaaattacaacccaacattaatagcaattatctttcaagtcttgacttagatgcaatgtcttcaggacgtccttcctgacttacctacattattaactccatttgaatttccatttttattgtagttggtgtggccgcctaaccagtcttgggggtctggctggtttggtttaatttacccaagtgttcacagcacattgtaattattggcagtagtgcaagactctctcatctcttctcttgcctccgttctcattctctcccctccctggagaatccattctaaacgtgtctggtatgtctctaagtatgagagtggcttttagaaatatgtagcattattgctctttatgtgtttttaaaatttaataaatgtcatttctctggttgaatcccattctgtttcttttctcacttgacactgtgctttttgagcatactgaggtcaaggcctcttagatccatgtggtctgacgtaatttaccaggcatgggttttcccagaggagggggctggttcatggttttggttttggttttccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaaggtgagctggaagctgaggtctggcggggctcaggaatgtcccccatgtgaaccatggctcttctttcttacaagcaattttctgcttttaggataaatggttgtctgtgtagatgttctggccccagctgtgatatattatcctcacaagtcagccactgtgatcttggtctcagacccccaaggttctcagggacttcgagggctattgtaccctcaaagagaagcagtaattgtgggagtacctcagaaagtctaaatcctcctgacaggcattgacataccctgttactgatcttgggggctgagacttgcctatactttgtgttcacttgggtgacctgggaaagagattagacatagtgatagtccctaaagaatctcctgtcccagcttggtggttttctttcacggtgtctcatttttcctcccttcctagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagtgagaattagtttctagtactctctgggcctgactcaggactatactgactcaatacagagcctgtgtcacttctgcgtttatcttggtcacaacatgaattattctttcccttgatctgggaacagtcacgaaaccagagtccttgggttagggtgggagaaaacatggcagatatctatcctcatatcttccaagaaatgaggagatctaatcacctcattatgtgcttccaaccctatgaactggtgtcctctaattctttggtcttagtatttaggaggcattcttatgggctgtgagaatctgtaaccgatgggtggtaactccatgggtgccactttggtttcgaagaaccttttctaaatttatttatttttctctagctagcattggatttggtgtctagtacagattctgggattccaagaaagtgctttaaatattgggatatttttactaatttaaagacctgtttcccataggagctcagtctgaatattcttggagaaagatgctgagtggcattgcagccttcctacttgggctaatcttccttctggtgggaatcgtcatccagctaagggctcagaaaggtaatgagcctgtgaggagtgccctgccacctgtcccagaccttccccactcccaccttccctaacgtcaatgatctgaggcaaggaaagctgattgtgcctctcagggatcaccgggataatttttttctgaagctagaaatgggataagcagagagagtgctgaccttgccagccatttgttcttccctcgggataatcatattgggtcctaattggggcaatccattcttttctcgatttctttccaggatatgtgaggacgcagatgtctggtaatgaggtaatgtctctttttccttgtctttgagtggcagatcattctcccggttctttggccagagggagatgacatgggggtagggaggagtaaggttgctgctgtctagatgggactgtcccctgagtctctggaacggctgtggggggtggtgaggctgcctcctgagaccttcatcactgtgcctccaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagtcccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgtacattttagtgaattatttaagaaaaacccctgtaatcaagtcaaggaacaggactttgccagctccagcagaagtctctgtacgtcaggccaatcaaagcctctccttcccctcgaaagtgaccatatcctgattttattgtaacctctttcatgtctttgtagtctagtcccccaggtatgtgttctggacgccacagcttagttgctttacgcctaactca

SEQ ID NO: 3769 - DNA, 2390 bp, Homo sapiens
  Genbank Accession No. X66899
agagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggccctcctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaaataaaattccaaatgtttaataaaaaaaaaaaaaaaaaaa

SEQ ID NO: 3770 - DNA, 1704 bp, Homo sapiens
  Genbank Accession No. X67235
cggagccatgcagtacccgcaccccgggccggcggcgggcgccgtgggggtgccgctgtacgcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagagctgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacaaaaaaaaaaa

SEQ ID NO: 3771 - DNA, 3530 bp, Homo sapiens
  Genbank Accession No. X67247
agatctgccgacgccgcagacccccttcccccagcccagggtcggaggcgagtcgccgggggtcggcagaggtcagcagcctgcgagaccctcccaggctcgtggccctaggcgcggcagctgacacgtaagtctcgtcgcccgacgttgtttcggcgctcagaaacaacgtaaagtaaaggggcggggcagcgttttacaaaccgaaccgtgaatctttgcggtttctctttccagccagcgccgagcgatgggtgagtgtgctctgcattgaggcgggtgaagggaggttgagctcaatcaggccccatcctgcttcacagcctactgaggagtccagacgccccgacccccagccagggacagccacgaggagtggtggccctcgggtttcggccgcccagcccgtctctgggggctgcgaaggctctgggctccgggttccgggcgcgggctgcgggctccgacgggcgccaacatggctgccgcgaggaggaggccccggcctggccgcacgtgtatgatgacaactcggtaatgctgcatactcccgagtgcgcggtggggaagccaaccttggagagctgagcgtgcgaccggccggcgcgggggtctccgggagctggcgagtcgctagcaccgagtcacagtggctcaagcttccttccccgcttccacatgcaggcatctctcgggacaactggcacaagcgccgcaaaaccgggggcaagagaaagccctaccacaagaagcggaagtatgagttggggcgcccagctgccaacaccaaggtgggtgcgagcgtgggcctgtccgcctgggaggtcgccttcccccgctctccagcgtgctcgggtctttccgtgtgacagttgtgcgttctttcttgggctctgatttctctgtagtagggcctgggtgtcctgtccccctttagctgttggataagtaagtaccaaagagggaatgctccctcaggcccccaaacctggagcttaggatttcagagagaaggatactgtgtggggacttgagcttctggagagggtggcgcctcgcgtcatagtcagaagcctagtcttgttttttttacagaggcttaattttcagcatttggggtcaggctttcctcttggaggcaagtagggtgatgaaaaagaatccttaggcgtggttgtggccgtcttggtcacctgtgtgccacttgccaatgcaaggacttgtcatagttacactgactgttgcctcctcccggcccaggttcctctccctcacttgccttgctctccttggtaacctagttcctgtaaccttgtgttttccagattggcccccgccgcatccacacagtccgtgtgcggggaggtaacaagaaataccgtgccctgaggttggacgtggggaatttctcctggggctcagagtgtgagtgaggccctttgggagtgggtgggaaaacgcacctaaacggtcttaagattcaccaagtgggcctggcgcggtggctcacgcctataagcccagcacgttgggaggccgaggcgggcggatcacctgaggtcaggagttcgagtccagcctgggcaacagagcgagactctcagtaaaaaaaaagattcaagtgcttttagcaagtagtctgtggcttagaccaaggcatttgaagtttctccttgctgaaagatcttaaggtagctggggagttctctccacccaggctgtcctgctccaatctctttttttgagattgggtctctgttgctcaggctggagtgccagtggcgtgatcttggttcactgcagcctccgcctcctgggttgaagtgattctcctgcctcagcctcccaagaagctgggattacaggcgtgtgccatcacacccggctgcttctgtatttttagtagagacggggtttcaccatgttggccaggctggtctcaaattcttggctttaagtgatccacccgccttgacctcccaaagtgctggggttacgggcgtgagtcaccgtgcccgacctgctctgatctttctgaactctgcagcctgagagattggggctggtaaagactgcgggttgccaaacataactagaaacgtgggttagggggttgtggaagacgaactgatgccccatggcttgtaaaggctgagagttcccttatttctccttaaggcctcatggggctgaagaacctggaaggaagtgtgccaggccattgtcctcagtttacttatgccaaatttctcctgtgagcaggttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctggtgcgtgttacttccctgtaggggttgtggggagggcagcctgactccagccttctcgtgatgaaaactctgtccagttctgctactgaagggagagagatgagagccttttaggctgaggaaggccagcactggggtgtgcagggttcgagaaagctcccagggcctgccttccttccctgagctcatatatttgtatccccttttcagactcctgaggaagaagagattttaaacaaaaaacgatctaaaaaaattcagaagaaatatgatgaaaggaaaaagaatgccaaaatcagcagtctcctggaggagcagttccagcagggcaagcttcttggtgagaaggctgttgtgttggaggtggggagtcgcagagattgagtgtgccgaggcacttttcccttgtctcagttcctttgactgccagccatgcagtctaaagggttcactgataacaggctgcgagcacaaaggggaacgtttggtcaccctattcgtatgaagctgaaatgggaagcattgggtagaagagtctgcataggcccgtgcttggagtctttgtatttggggaagtctctgcccaggctgagggggctgtctcagtgatgaaaactttgtccagttctgctactgacagtaagtgaagataaagtgtgtctgaggagacagctggcttcatgcttgcccccagggtacctgaacccacagagattcttaagcgggtggagaggtttgggtagggccaccttgtcgttgtgctaaggatcacctactctcttgcagcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaatatatgactgttttctctgctttatttccttgccctgcaaaactgatctgggtgggtggctgcaaccccttgccttaacctctgcctcctactgtcctgagccaggctcaccacactgtaaagtcc

SEQ ID NO: 3772 - DNA, 597 bp, Homo sapiens
  Genbank Accession No. X67325
agctgaagttgaggatctcttactctctaagccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtgggtactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctgggtgaaatataccaaattctgcatctccagaggaaaataagaaataaagatgaattgttgcaactcttaaaaaaa

SEQ ID NO: 3773 - DNA, 2679 bp, Homo sapiens
  Genbank Accession No. X67491
aatattgtatgatttcacttatacgaggcactagaataggcaaattcataaagacagcaagaatagtggttaccaggggctgaggaaagggagaaattgagttattttgtttaatgagtttccatttgggatgatgaaaaaagttgtggaaatggatattggagatggttgcacaacgctgtgaatgtacttaatgccactgaatcatacacctaaaaatgattaaaattgtaaattttatgttacatgtattttaccactataaaaaagcaataggtgcataagtaaaagcatcacacaccagaaaattatagaaaatgagaagggaaacctcctttttcctgtcctcctccccttaacaaataccaagtgttcgtagtggttgtctctgtaattctaaatcattgaggtaactctctataccttgattgttcctctgtagtgtctgcaacctcctctccaaggatgaggaattgactgcacttccactaagtcctaccaaccctctgcttctgtctcttgatatttgatagttacatcatactttggattttccagtggttaacttttagctttaaataacatacttaggctttttctccttaaattttttaaatatggaaattttcaagcatatacaaaagcagagaaaagactacagtaagcctctatatacccagccttctgcttctattacaaactcatagtcaacttgcttcatctgtatctccacgcactcccctccaccaattattttgaaacaaatcttagacattgtatcattttatctacatatttcagtatgtatgtcttaaaaaaataagcattctcatctaggtcaatgccattgagaaagtcttcaaagtgtacaatgaagctggtgtgacctttacatagatggatcgtggctgacttcctcactaccctcttcacctgtaacttctgcagacctatcacaagtttacatgtaaccacagaaatccctttccctcctgactcattagataatggataccattcgcaacaagtcaatccaaatcagccccttaaggagaaacaaattaaggttaggggatcatgtaaaagctgagtgtgaaagtagaaatcacctacaccagagagccattttggtattttgcctttaaactctcctccatctggctgtgcagtcttgctctgtggcttttcccaacacaatcagtgctattgctggggagggacagtcaagagcagtcagttgctctggacaagtctgggacatgctataactttagcatatttaagaagtaggggtgtggcattttcggaaggtggcatagtcctcaagtgagttcttagtattttatatcagcaaaataactcaattttacaggttgcaaacaaatataaaagctgtttctatttatgaattttattctttcagaataaaataagtacatgctgctgtaataaaattgcctttaatcacttaacaaccctaaccttgactcaaacagtgaatgcctataaaaataagaaattttaaaaactagtatttttatatcataaaacaatgtcatttataacttatcagtcatgcattgttgtccagcaaacattaaaagccctgtggataattatcttcatacttgcaaaaatgatagaggctatttttgttaaaactgtcagaatttgctaactatgacacatgggccaaagaaagcagtaacctccttatcatgttaaccaattgttctcttttgaagatctattgttgactaattgaacaataatcaagtggagtgtcccagaaagaaaccacttgggctccctgtttggagtctggctggctctgagcattgccaatggcccctactcgcctgactttgtgtcctctccttttagaggccttgcgttctgcagctagcttcattaacagtgggctgaaaacaactttgggttgagtgtttcgtttgggagttatttggccagggctttagagcagtagtgtcccaatgaagtgctagataataaatgtgtacaaatcagttcttttttttttaactataactccctttcagaaatttctaactactttgtaactgcattacttaacctggtgataaaagcagttattaaaagtctacattttccaggccaggcacggtagctcatgcctacaatcctagtgctttgggaggccaaggcgggtggatcacctcaggtagggagtttgagaccagcctgaccaacatggtgaaaccccgtctctagtaaaaatacaaaaaattagccgggcgtggtggtgcatgcctgtaatcccagcaacttgggaggctgaggcaggagaatcacttgaacccaggagcggaggttgcagtgagccgagatcgctccattgcactccagcctgggcaaacaagagcgaaactccatctcaaaagaaaaaaaaaagtctacattttccaaaaataaaaaaaacaaaaaaaaggatgctcaagaaagcataacctcaatgccattaccacacctaaaaaaaataattccttaatagccagtgactattgaaattttactctctttttctctgtgttcaaagatgtatctaaatacagtccttatactacaatcaatttacacgtctctttagactcttaatctataggtcctcactcttctttttcttcctatggcaatatt

SEQ ID NO: 3774 - DNA, 2000 bp, Homo sapiens
  Genbank Accession No. X68277
tttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattg

SEQ ID NO: 3775 - DNA, 971 bp, Homo sapiens
  Genbank Accession No. X68314
cggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggcaaaaaaaaaaaaaaaaaaaaaaaaaaaaaa

SEQ ID NO: 3776 - DNA, 1269 bp, Homo sapiens
  Genbank Accession No. X68679
ggcacgagctgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccgtcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagtccgtcagaccacagttacatgtacggagaatggctggtctcctactcccagatgcatccgagacagaacatgctcaaaatcagatatagaaattgaaaatggattcatttctgaatcttcctctatttatattttaaataaagaaatacaatataaatgtaaaccaggatatgcaacagcagatggaaattcttcaggatcaattacatgtttgcgaaatggatggtcagcacaaccaatttgcattaattcttcagaaaagtgtggacctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggcaccacctagatgcatacatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttataaaaaaaaaaaaaaaaaaaaa

SEQ ID NO: 3777 - DNA, 255 bp, Homo sapiens
  Genbank Accession No. X68688
ggggaaaagccctatgaatgtaacacatgcaggaaaaccttctctcaaaagtcaaatctcattgtacatcagagaacacacataggagaaaaaccttatgaatgaattggatattagaaatttccagccacaagtcagcctccataatgcctcagagtcttcacactgtggagaagggcctgatgacatcctgaatgttcaataactatccacaaactcgccttatgttactccaaagtaacagtaggggataaa

SEQ ID NO: 3778 - DNA, 561 bp, Homo sapiens
  Genbank Accession No. X68733
ctgtctcaaaataaaaataaaaaataaaaagaaataaaaaagaaatataccaaaatgttagctggggtcttctctgggtagtaaagtgctgggggatattttccaaagtccttctttacattctctgagtttttccatgttcttcaatgagtatttaataagcagataaaaactaatacaacaaaggattttttctgtgtgcttttttgacctttggaggaagagattagagctagtcccataaccaggttatttgagtaggtctaataagcccgtattaccagaaattatcatctggtcatttccagtccgagaacagaacacttggttgtcctggcatttcccaagcagtgggaggagttctctgcaggaataaataagcctcagcattcatgaaaatccactactccagacagacggctttggaatccaccagctacatccagctccctgaggcaggtaatccatgatgttttacatcctgggagcggaggaatctgtttttccaggagagttttaggcagcagcctggagtgtgtggagtgtgaggggtaagcagag

SEQ ID NO: 3779 - DNA, 549 bp, Homo sapiens
  Genbank Accession No. X69150
cctctcttccacaggaggcctacacgccgccgcttgtgctgcagccatgtctctagtgatccctgaaaagttccagcatattttgcgagtactcaacaccaacattgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagttatatacaaaaaaa

SEQ ID NO: 3780 - DNA, 926 bp, Homo sapiens
  Genbank Accession No. X69391
cttaattctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagcccccattgcagccgcaaccctgtccttctcagaggaattggcaggtattcccgatctgccatgtatccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactgacctctggtcctcaatcgaggttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactac

SEQ ID NO: 3781 - DNA, 1285 bp, Homo sapiens
  Genbank Accession No. X69398
gggctgcctgtgacgcgcggcgcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttctgtttaagcaccatggccttgatgattcactgttggggagaagaaacaagaaaagtaactggttgtcacctatgagacccttacgtgattgttagttaagtttttattcaaagcagctgtaatttagttaataaaataattatgatc

SEQ ID NO: 3782 - DNA, 438 bp, Homo sapiens
  Genbank Accession No. X69654
gctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccagctcccccaccaaagcccatgtaaggagctgagttcttaaagactgaagacaggctattctctggagaaaaataaaatggaaattgtactt

SEQ ID NO: 3783 - DNA, 15016 bp, Homo sapiens
  Genbank Accession No. X69908
ctgcagtgagccatgatcgtgtcaccgcaccccagcctgggtaacagaacaagaccctgtctccaaaaaataaaataaattaaaaaataaacaaattcaaaggaaggtgaagttcttccccagcaaaaatgtttttggtcatccctctgccaccatctctcctactgattcctccctcagaagcctggataccagtgatcctttcccttccttcatctactgttttctttctttagaagtagggaggtttaccgatgtctcacagtcctgatgtcttagggaattgatttagcaaggaaaagtagaaaatatatcagtcagttcccaccagcccatcacagcccaggagcttgaaattaacaatcactaataaatagagaagctcaatatgtataaagtattggcagtgcaaagtttccactttaacttgcagaaaagtgcctgtttagcagaaagaaagaaaatcctggaaagttaacactggatgaaatcttagagatcacctacttctctccctgatttttccaaatgaggaaactaaagcttcgagagatgaagtaactagcatagttattcaactatttagtagcagggctaggactagactccagtctcctgcctcgaagacagctgttctatccatgccacttgctggcaacatgtgcatctagcaaaacacatcataaagtatcctcatcttaagccatcaggaatggaaatcaaaccatttaaacccttcctcttctctctagcaatattttttcttcgcatttctctgtgccctggtctctctctctctctctctctctctctctctctctctctcgtttttaaaatcactcctgtttctttcgtggctctttctcattgtggcatgcctgcatgagtatcttgatttttctgctctaagctatggtttcttgtccaaagaaacatatataaacaaatcaaaacccttccttggtgacctttgtagaaaaggacacttggaatttctatatgagagaagctgaacctctctcttagcctatccagtcaattaaaatgagtctgtggcccccctgagggttgttaaccaatcctaagaaaggaaagatcaatctcatttcttcgtcaccactgggcagggaggctgccaaccagtcagaatctgccactcacagtcattaaaaaaactggccaatcagtccaaccttgttatatggtctggtaggaaaagaaagggactgattggaaaggatagttctgtctccacaccctttccttcctggaccccggttttccctttgtgaagtgaaagaaggacccttccccaagcctatagttaagaagatcctccgaccctcagctaagcttctcttggatcttttgctgtcttcaaattcacccctccccttacaaacctcctttttggagcctcactgctcccttgcggatttgatttcttgcttcaagcctcgtagtaatagtcccaggattctcagcctcccctcagatctccactcaccagcaagtaaaataacttgttttgtatgacttatgcaggtgaaaacgtttttaaagtgtagttgagtctctttcaggagatactatctcaaggaccttgcaataaacagtccatataggtagcagtgcagaattgagttgcaatgcccttaactatagaagcagtgatgatgatggtgatgatggtggtgatggtggtggtggtggtggtggtggtgacgatgatgattttaatgctagcaattactgaactcttactgggtaccaagtaccttgctaaaagcttcatatgtattatcccaatattggctgtgtgataagtactattattcttctcaatttacataggaggaaatagatttagagggggttaaacagctagctcaagatcacacagcaatttgggaacccagatttgtctgaacgcagaacccattattctatgagggcaagggagtgttaaacatcgcaggctgtaacaacttttggaaagagccagctttagcttcctcccaggccccttctctgatcctcctctgggattgttagccatatctgagtgtctaaattgtcgcaacagctgcaacagccgtttgggggtggtggctcctaagaactgtggactttctctgccactgaggatgtgaagctgacagcttaaaagaattccgttttggtgggaatggagatgtctggagacctcaggggataaacttgtgtctttgctagcctgtctttctcctaacagcatctccacagtgcctggcaccacttggtacttgataaatacctgttgattgattcccaaagatcccagttccatttcccacgtacctgcccgctcggggcgcaatcaacaactaaaactggagatttggggatttcagaggaacctgtgagaatcctgatggagctggaaatgcgaatttaggaaagacaggcagtctaccaccctcctcttctcgcccgcttctcctatttctccccactccttcccctccctttcaggagctcagggccataaaaatgcagatggaggatcggtgtgaaataacgggcccatataaatccctctgccgcccgcctgcaagatggattggccgcattgaaattcctccgcgaggataattaaactcggggcctcatccgggcaaaattacattcctgtaatggcgtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgctgatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcaggtaaggccttgggacctagagccctctgtgcgctgcgcacgcgcgcgggacacctcaccttgcgcggatgctttgaggcgcttaccttgcgtgctcccaccctggtcctctcgccctttcttgcttccgctatcccttagccttagagttggctcttccgcgtgccggtgacctccaaccgcgcgggcctggcgccatcttggatgtctcgcagggggaggataccttggagctggccaaagttagatcctggagtgctgcttttcacctgttccacccagtccctgcaaacactcttttctcgccctctggccctttcagattgtgacaacccccaggctctcccctcctatctctgctttctcttctcatcctgacttgtgccttctttattctgaaatctccagactttaggccccagaacctcaggtgctccgagcaatggagatagtggatcgtctaaagtcaccaatccctctagtcagcacccctcaatttaaaaagtaaaccttgaacatggtagaagtgggaaaaaaagccaaaacatcgcctcccgttaggttgtggcttgggatagctaaggcagaagagagaggctggttgctttggaatcactagttatttaccagtacctttctcgcatcccggcacgctggtgaagttgtaaaagtcacaaatggtgggctagagatgagggtttctgttgaggcagcaggcccagaaaggtggggtaaggccaagctagtggggccagcatgagaccctgcctgccagctttcctgtgaaggattaattaacctccccagattctgctgttacaaggaaaagaaggtttaaggaaaggaatagttaagttactacccctgtgactcatctacactgaggaaaaagcccgtgatgattttggagtcctgattctggatagtgcctttgcccaagttgtaggctaacaattgcagagttgccatggttagatagccaatggtgggatcacttaattgccaccccttgttgtgggtttattatatgccagcaccacattaaactctttatgtatgttaatttgtaaatgaacatacttaatccccctaagagctgcattttacaaagaagataataaggtataattcccttagaaaagaaccaccccttctttttctaaaagccttaaagaactattggattttgacccaagaaaacctgaatagtacggcagcaaaattgggttagagttacatataggcaaaaatcagagttctagataggacaagagttgaagacatccattaacttaaaagtaattaaggctgggtgtggtggctcacacctgtaatcccaacactgggaggccaaggtgggaagatcttttgatgccaggagttccacaatagcctgggcaaaaaataaattaagagcaattaagatgttggattcagaagtgttttaacctgggacaatctgagttcagttcatttaatgaagtggtatttaatagccctaagcattcactgagtatttcagcctgtgacatattagaaagcatgtaacttaaaagatccaagttcaagtctatcctctaccactaccacagtttcaagactgggtttagggtcacgctcttgcgttaagtatacctaataatcatctgggaaacttgtttgaaatacagggcacttgagccttattcccagagatcttttttgtttgtttatagacagggtttcacgttgttgcccatactggacaactggcgtgatcatagctcactgaagcctccagctcctgggttcaagcagtcctcctgcctcagcttctggagtagctgggactacaggtgcacttccacctcacctggctaattttatgttttgtagagatgaggtcttgatgtttgcccaggctggtctcaaactcctggcttcaagttatctttccgccccagcttctcagtgttgggattacaggaatgagccactgaacctagctcccccagagatcttgaccaggaaggtccaagttgcgcccaagaatatgcattttttaatacgtacaccacccagataattctagttcagatgggcttctcacttcacttggagaaaccctgcctttaggtttttaactcaccttctgtttgaggtaagttcacttctaccaacttagatacctatagggtgtcagatcttctttagatcttggggagacacaatttaatacttttttttttttttttgagacagtttccctcttgttgcccaggctggagtacaatggcgcaatcttggctcaccgcagcctctgcctcctggattcaagcaattctcctgcctcagcctcctgagtagctgggattacaggcatgcaccaccatgcccgactaattttgtattttcagtagagacggggtttctccatgttggtcagcctggtctcgaactcctgacctcgtgatctacccgcctcagcctcctaaagtgctaggattacaggcgtgagccactgcgcccagccactaataccttttggatagactaataacagagttcctccttgatcttcctcatcttattaatacaggaaattgaagtattttcaggaatcagatacttccagggatcagcaaagagattgttggagaccttccagtgtcttggccttcaacaaatatctcccaaaactacaaagactctaaagggcaactttttgtttgtttgtttgtttgtttgtttgttttgagatggggtctcgctctgtcacccaggctggagtgcagtggcgtggtctcgtctcactgcaacctccgcctcctgggttcaagcaattctcctgcctcagcctcctgagtagctgggattacaggcgcgtgctaccacacctggctaatttttgtatttttagtagaggtggggtttcaccatgttggtcaggctggtctcgaactcctgacctcgtgatccgcccgcctcggcctcccaaagtgctgggattacaggtgtgaaccacgtgcccagcctaaacggcaacttttaaaggtccagatgatgaagtcttgagaagcgttccttttgaataaaaactaaggaaaacttaggcaaaagacactctgggaaaattcctgtggcaactgcaaatcatgaggctatggaaatgggtaacaggtcttacctgaacccaagtgttcacttgttcagaccaggggaagtcacttcattataaggaaatcttgggagctgtgtggggtttctggaagaagtcatgacttcagggttttaattctatttctgccaatgacttaaggtcagtcactgttttctgggccagttaagctttctagggccccttttctgctaataaggatatagtttagtgaataaggagcgtttacaatactgcttctgtaattccagctctcctgccacagctcctcaccccctgaaaatgttcgcctgctccaagtttgtctccactccctccttggtgagtacctgcttttctgggagagttttaaaggagagacatcttgtctctctctttccatcagaccttgttcttcacagcaaggctgggggagaggaggtccaggcgggcagatcacttgaggccaggagttcaaaaccagcctggccaacatggcgaaaccccatctctactaaaaaaacgaaaaccagttgggcatggtggcgggcgcctgtaatcccagctactcaggaggctgaggcaacagaatagcttgaacccaggaggtagaggttgcagtgagccaagatcgcaccactgcactccagcctgggcgtcagagcaagactctgtctcaaaaaataaataaataagtaaataagtaagaaagattcttggggagggaaggccctctgctatgattgcgtaacaggatagagtgaatgcttgctagatactctcctgccccatatcccttggcggccagttaattttttttttttttttttttttgagacagagtttcgctcttgttgcccaggctgcaatggcgcgatccaccacaacctccgcctcccgggttcaagcagttcacctgcctcagactcccaagtagctggggttacaggcacctgccaccatacccagctaatttttgtatttttagtagagatggggttacaccatgttggccgggctggtctcaaactcctgacctcgtgatccgagtagagacagggtttctccatgttggtcaggctggtcttgaactcctgacctcaggtgatccgccgtcctcggcctcctaaattgctgatattataggcatgagccaccgtgcctggctgtgcccagttaattcttacccagccatcttaggagaagaatagagatgagaatctagaccaagatcaagttattcctactcctgaaactatatgtcgtgtaagctggccatccagagtggtaaatataagtagattacataacttggactgagtatgcactgtctgtaggatcttgtcctgagttagccatagctaaggagttcattctgggacttaaatttggataggaagctaaaatttacataaatacacattggaaaagtatttgactcagaaacaacagtatggaagaaatttttgaaatagtagctagaggaggcggttggttcattcacaaataaaaaggagtaccatttattgagcatttaccatgtgccttagcactcactgagtttactaattggtatacataatctcatttactcttcaaatcaaccccaagagatgatattttgatttcataaatgagaatacaggcttagaaaggtttaagtgacttatcctgagaatacactgctgataatagaattaagatttgaatctcactttatctgatgcctaaagccctggctatgaatcaccatgtgtctgttttggtgtcactggcttggggttagtcagaaaaggctaccagaaggaggtgagttttgagcatgaatctttgttcctattttccaaaaggatgtgttcagggaaagttactggcttctttcttgtgggctgaccattacccatacagaaggcccccaactttagattaagattttttttttttaactttatgatgatgcaaaaatgatatgcattcattagaaaccatacttcgggctgggcgtggtggctcatgcctgtaatcccagcaccttgggaagccgaggtgggtggatcacctgaggtcaggaattcaaaaccagcctggccaatatggtgaaaacctgtctctactaaaaatacaaaaattagctgggcgtggttgccggcgcctgtagtcccagctacttgggaggctgaggcaggagaattgcttgaacctgggaggtggaggttgtagtgagccgagccgagatcacgacactgcattccagcctggcgatacagcaagactccgtctcaaaaaaaaaaaagaaagaaagaaagaaaccatacttcgaattaggaatctttatcttttcccaagctagcaatgtgtggtacaatactctgttgcaatactcagcaggaacccacagctcccagtcacctgcccaatcacaggggtaaacaaccagtactctacggtgtactgtgttgctaggtgatttcacctaactgtaagctaatgtaagctagtgtaagctttttgagcacattgaaggccagactatggtgtttggtaggttagcagtattaaatggtttttcaaagtatgatggatttattggcacataaccctatggtaagttgaggagcatctgtatatatttcccttgttgagtgaggcaaatgcttctgaggcttagatttcttcttgttctcaagagctataaaaggatatagcaaggttggatgctcccttatggcccaaaggaagtagactttctttccttaaagcaaagtctgagaagcaagagaaatggtgtggttctttaatttagactttgctaaaaggaagaatgatccaaaactctaacgtacatgtgaagatggaaaggccatgagaggaaagaaaatcttgtctgatgatgtaacaacgtggcatagttctgaaactcctctccagtcttccttgaccttcctgcccctgtatgtcattcctgctaggtcaagagcacctcacagctgctgagccgtccgctatctgcagtggtgctgaaacgaccggagatactgacagatgaggtaccttacagtggagttgggactgtggttttgggggtgatgggtggggagggttacctgccagaaccaggaggtagaatgctgaggacagtcatcacaggctaaaattcatgaatggccaaggccatgggctttaggtggagatggaggacacttaatacgctgtatgctatagtgctccagcttttgccactggcagcacatgcccctgtgcactgctgctaactggtattacttggcctagtctactgacttcagttggaagcatttagtcctaggaagatgatctccttggggcagcaagaatagactagggcctcagtcttacacttcttgaccacacctgaatcttaaaggcatttgaagtctacatcctacgttaaaaggttctacttgccagcattttagggcgttaaacaattttctgtttgggggagaaacaatgggatttggcagcttaaagggttttaaatggtacaaaagttaccaaagcaaaaaactttaccttctacctgcctctttttcacagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggtaagataagttggaccctccactggttatctgatatgctttccaaaggtcagaaaatatttgggggtctagaactatactatcccacactgtagccactagctacatgttgtttgtttgtttgtttgttttgagacagtaacgctctgtttcccaggctggagtgcagtggcgcaatctcagctcactgtcacctctacctctgggttcaagcgattcttgtgcctcagcctcccaagtagctgggattacaggcacacacaatgacgcccacctaatttttgtggttttagtagagatggggtttcgccatgttggccaggctggtctcaaactcctgacctcaagtgatccacctgcctcggcctccctaactgccaggattacaggcatgagcccccgcgcttgacctgaattttagttttaattaattaaaaatacatagtttcagttttcagttcttcagtcacgctaaccatatttcgagtgctcagtagccagatgtggctagaggctaccatattcaacaatgcaaatatagaatgtttggctgggcacagtggctcactaatcccagcactttgggaggccagggcaggtgaatcgcttgaggtcaggagttcgagaccagcctggccaacatggcgaaaccccatctctactaaaaatacaaaaattacctgggtaaggggggcgtgcacctataatcccagctattcaggaggctgaggcagaagaatcgcttgaacccgggaggtggaggttgcagtgagctgtgagccgagatcatgccactgtactccagcctaggtgacagagtgagactttggggaaaaaaaaaaaagaaaaaaacaaatataggctgggcgaggtggttcatgcctgtaatcctgcactttgggaggtcaaggcgagtggatcacctgacgtcaggagtttgagaccagcctggtcaatatggtgaaaccctgtctctgctaaaaatacaaaaattagccaggcgttgtggtgggcgcctgtagtcccagctactcgggaggatgagacaggagaattgcttgaacccgggagacagaggttacagtgagccaagatggtgccactgcattccagtctgggcaacagagtgagaccatcaaaaaaaaaaaaatttatatatatatatatatatatatatatatatatatatatatatgtgtgtgtatgtatgtatgtattagaatgtttatatcattgtgtcattgaagaaagtttcatgaacagctttggtctagagcatgtgttggcaaactaaggcctaagggccaaatctgggccatagccaggttttgtatgattgagctaaaaataattttatggccgggtgtggtgccttacgcctataatcccagcactttgggaggccgaggcgggcggatcacgaggtcaggagttcgagactagcctggccaacatggtgaaaccccttctctactaaaaatacagaaattagccaggcatggtggcagatgcctgtaatcccagctactcaggaggctgaggcaggaaaatcacttgaaccctgaaggcggaggttgcagtgagtagagatcacgccactgcactccagcctgggcaaaagagtgaaactccatctcaaaaaaaaaaatagtttcgcatttttaaaaggcttcatttttgttttaaagcaaaagagactatatgcggcccacaaaacctaaaattatttacaatgtggccctttacagaaaaagtttaccttccctgttctagagactcagtgaacatagtggctttactgctattttttcccatctctgggaatttccctctgtcactcctgggaaaactggcactgcagccagcccctggtttctgacacctgggactgtttagtactcccagctctggataactcagttaaaaccaaattaatcctctagagaccaggaagttctcttaatgtcttttgagaaatagagttctttttaagaatttgtattaaacaagaagtctgactgctgctttattcactattctgttaaatgttggtgtcgatttaccttacccatcaagacttctggaggtatcagagtaagggaaatacagattatatatgggccttcaacactgggagtcctttatccatactacttcaactcataaaccccatagaccatttgtaacttcttttttttttttttttttgagactgagtctcgctgtctcccagactgaagtgcagtggcacaatctcagcccactgcaatctctgcctcccgggttcaaatgattctcctgcctcagcctcccaagtagctgggattacaggtgcccaccaccacgcccggctaattttttatttttttattttattttattttatttttttgagacagagtctgactctgtcacccaggctggagtgcaactgtgtaatctcagctcactgcaacctctgcctctcgggttcaagcaattctcttgcctcagcctcccaagtagctgggattacaggtacgcaccgctacccccagctaatttttgtattttttttctttcttttttttttttgagacagagtcttgctctgtcgcccaggctggagtacagtggctgcggtcttggatcactgcatcctctgcctcccgggttcacgccgttctcctgcctcagcctcctgagtagctgggactacaagcgcctgccaacacgcctggctaattttttgtatttttagtagagacagggtgtcaccgtattagctaggatggtctcgatttcctgacctcgtgatctgcccacttcggcctcccaaagtgctgggattacagacatgagccactgcgcccagcaatttttgtatttttggtagagacagggtttcaccaggttggccaggctggtctcgaactcctgacctcaagcaatctactcatctcggcctcccaaagtgctgggattacaggcgtgagccaccgcgcctggcctaatttttgtatttttagtagagacggggtttcaccatgttggccaggctggtctccaacttctggcttcaagtgatccgcctgctttggcctcccaaagtgctgggattacaggtgtgagccaccgcacccagcccatttgtagtttcttaaagccccagatcttctgactatttgaaatgagagaacataatctgtccctcttactcttgtcttctagaagagcggtgttccataaatccttaggattctgaggttatgccccagagactgtcttagagaataaaggggagaccaagccgttaaaatttccccactacttttgtaccattgcagtttggcttttagatgtttactatattggagttctgcttaaagtttgaaaacactgctctagatagacccttccatcctatttgggccctggatattaagtgtctgggccaagaggtcttaatttgtggtaatgagatgggtgaaccattagtgaaggtcatgattatacctgggccatgttacaggattttagattgcctgctcccccttcattcagttcctgtagagcctttggggaatcagggcaagaatttgggcatgatggtgttaccctaaaagcttctttattatgtgagataatcttgaagagggggattctccctgagcccatcttagatatttatccttttctttgtgtgaactagaaattcagtcttttctcttctccttctaccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagatgtttcttgagtctcctgtgtatatttcttttccacagttggctgagtgccttcgtgagagtacaaggcccgaagggtagtgatggtgctaaactcaacatggatttggctgagctc

SEQ ID NO: 3784 - DNA, 2910 bp, Homo sapiens
  Genbank Accession No. X69910
gggggagcccctgcaagtttcccgggccgcgcgccgcgctcgctcgcctcccagcccgcggcccgagccgccgccgcgcccgccatgccctcggccaaacaaaggggctccaagggcggccacggcgccgcgagcccctcggagaagggtgcccacccgtcgggcggcgcggatgacgtggcgaagaagccgccgccggcgccgcagcagccgccgccgccgcccgcgccgcacccgcagcagcacccgcagcagcacccgcagaaccaggcgcacggcaagggcggccaccgcggcggcggcggcggcggcggcaagtcctcctcctcctcctccgcctccgccgccgctgccgccgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcagccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggttcgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggcccctgcaggggccctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgttctcttcctgacgcatctgtgatatcagaggtaactatgcaaagcatccaggcggttctgaatgtgaagcactacacccagcagagtcccggtgccctctgtccccactgccggcccatgtcctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaa

SEQ ID NO: 3785 - DNA, 4541 bp, Homo sapiens
  Genbank Accession No. X70040
ggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaaggctgcctctgggccatgccaggccagagcagtggccctccaccttgttcctgccctttaactttcagaggcaataggtaaatgggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 3786 - DNA, 3073 bp, Homo sapiens
  Genbank Accession No. X72012
cctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgtgagtaccccaggcccccacagtgagcatgccgggcccctccatccacccgggggagcccagtgaagcctctgagggattgaggggccctggcaggaccctgacctccgcccctgcccccgctcccgctcccaggttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacctgaaaaaaaaaaaaa

SEQ ID NO: 3787 - DNA, 667 bp, Homo sapiens
  Genbank Accession No. X72177
  unsure (1)..(667): n = a or c or g or t
ttganttgccttaaggaaggcagaaaaangcaaatattttctaaaatcacatttgaatctctgactcaggatgacttgtgaaggtttacctcaaaaaagcatttgatatnngttatgtattctttcattttagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacaggtgggtgtgagctttgtggcttttctttgtgtcctggaaggactcaaggatgaagtcagcaacatcaggagtgcaacactaagcaatgggaacatatatatatcaaagtaagaacttacaaatttggatgaaatttgaagtctctctcttatgaggttgaaaggaantctangtttgttctttctacaagaacgaggggtttcaaagaaanttaattaagaanctgngcaacactttcagttgaanatttaantngcttagaancactacccaagcttttttcaancagcatacaanntngcttgcctatagttagtgagttaattatagagaannttctactcantaaancgagtctaacaggacctcag

SEQ ID NO: 3788 - DNA, 1901 bp, Homo sapiens
  Genbank Accession No. X74801
atggggcatcggccggtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaagttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagccggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggaggaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtcgcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaa

SEQ ID NO: 3789 - DNA, 1752 bp, Homo sapiens
  Genbank Accession No. X74929
ctgctccttctaggatctccgcctggttcggcccgcctgcctccactcctgcctccaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaccc

SEQ ID NO: 3790 - DNA, 1444 bp, Homo sapiens
  Genbank Accession No. X75252
ggggggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgcctcgctgacagcttgggaggaaacctgagatctgtgttttttaaattgatcgttcttcatgggggtaagaaaagctggtctggagttgctgaatgttgcattaattgtgctgtttgcttgtagttgaataaaaacccg

SEQ ID NO: 3791 - DNA, 2232 bp, Homo sapiens
  Genbank Accession No. X76105
cgtggcactcacccggctcgcgcggccccggccgcccacgccgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagcttcagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcgccccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctattttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagg

SEQ ID NO: 3792 - DNA, 3151 bp, Homo sapiens
  Genbank Accession No. X76180
ccggccagcgggcgggctccccagccaggccgctgcacctgtcaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaaaaaaaaaaaaaaaaaa

SEQ ID NO: 3793 - DNA, 837 bp, Homo sapiens
  Genbank Accession No. X76648
aattcggcacgaggcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatgagaggcacaagtgcagaggcctgtggtcatgtggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatgaaaaaaaaaaaaaaaaaaactcgagggggggcccg

SEQ ID NO: 3794 - DNA, 415 bp, Homo sapiens
  Genbank Accession No. X76717
ccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgcmaagtgtgcccagggctgcatctgcaaagggacgtcagacaagtgcagctgctgtgcctgatgccaggacagctgtgctctcagatgtaaatagagcaacctatataaacctggatttttttttttttttttttgtacaaccctgacccgtttgctacatctttttttctatgaaatatgtgaatggcaataaattcatctagactaaaaaaaaaaaaaaaaaaaaaaaaaaaaaaaa

SEQ ID NO: 3795 - DNA, 3436 bp, Homo sapiens
  Genbank Accession No. X77548
caatcgcgaccctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaacgctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctggccaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagctttccaactgcctcttaccggaaatacttctgggggaacttcatggtcccaaaatgtcattgccatacagcttcaccagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtatttgtcaaaatataatttcccttaatcactatgttaatgagtatgtaaaacattcttttgcattgatgaattttgtatctgcttcccttaaagcataacagccataaaaaaaaaaaaaaaaaa

SEQ ID NO: 3796 - DNA, 861 bp, Homo sapiens
  Genbank Accession No. X77588
cggccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctcgtggccg

SEQ ID NO: 3797 - DNA, 1830 bp, Homo sapiens
  Genbank Accession No. X78687
tccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatattt

SEQ ID NO: 3798 - DNA, 2461 bp, Homo sapiens
  Genbank Accession No. X78706
  unsure (1)..(2461): n = a or c or g or t
agccttcgctgccaggaccgtggtgaagcctctgggcttcctgaagcccttctccttgatgaaggcttccagccgcttcaaggcacaccaggatgccctgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggggcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctggnggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggtttgacaagacgctgcagttcatcgtggcagaagatggctcctgtgggcttgtgtacgagcatgctgcagcngagggtttccctattgtcacccttctggactatgtcatcgagtacacgaagaaacccgagcttgtgcngtctcccatggtgcccctgcccatgcccaagaagctgcggttcaacatcacccccgagatcaagagcgacatcgagaaggccaagcagaacctcagcatcatgatccannacctggatatcaccgtgatggtgttccaccattttggaaaagacttccccaagtcggagaagctaagcccagatgccttcatccagatggctttgcagctggcctactacaggatctacggacaggcatgtgccacctatgaaagtncntccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccggggctacaccgaccgggccatccgcggggaggcctttggtcgacacctgctgggcctgaagctgcaggccatcgaggacctggtgagcacgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtcccccnnaaatgtactgagccacggaccgcatcctccagggacctgcaggccccagccaagtgccttccgtgggtcatcccagcacctgccagggcccgacctggggctgagtgcagaggctgagcaggacgttaggcccgggcccctggcacgtcctccaccggtgcctcctctgggaaagggaaccaccctccagagcaggagactggcaagagctctttgtctcaccagctcagccccggccactccctgccaactccatgaccaggccaccatctgtaccctgcttcccaaactcccaggcctggagacaggattgtctggggncgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggg

SEQ ID NO: 3799 - DNA, 1629 bp, Homo sapiens
  Genbank Accession No. X78992
gggccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcggggaccccgacatgctgcgcctccgcggcggccgcgctgcgtctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctggggg

SEQ ID NO: 3800 - DNA, 591 bp, Homo sapiens
  Genbank Accession No. X79234
atggcgcaggatcaaggtgaaaaggagaaccccatgcgggaacttcgcatccgcaaactctgtctcaacatctgtgttggggagagtggaggcagactgacgcgagcagccaaggtgttggagcagctcacagggcagacccctgtgttttccaaagctagatacactgtcagatcctttggcatccggagaaatgaaaagattgctgtccactgcgcagttcgaggggccaaggcagaagaaatcttggagaagggtctaaaggtgcgggagttggagttaagaaaaaacaacttctcagatactggaaactttggttttgggatccaggaacacattgatctgggtatcgaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttccatccaaaagagcaataaaaagttttcagtgaaatgtgcaaaa

SEQ ID NO: 3801 - DNA, 1198 bp, Homo sapiens
  Genbank Accession No. X79536
ttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctctaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggcaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattagggaggagtctgctactagtcttatcagctcttaaaaacagaaactcatctgtccaagttcgtggcagaaaggaacgtccttgtgaagacctttatctgagccactgtacttcgttatcacgccatgcagtttacatgagctgttctgcagctcgaaattccattttgtgaatgggtttttttttttaataaactgtatttaactt

SEQ ID NO: 3802 - DNA, 2840 bp, Homo sapiens
  Genbank Accession No. X79882
cctcgagatccattgtgctggaaaggttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtgccagtggcccagccctggggaggggatatccccccagtctgctcaggcccctcaagctcctggagacaaccacgtggtgcctgtactgcgctaactcctgattaatacaatggaagtttctgggcaaaaaaaaaaaaaaaaagtttcca

SEQ ID NO: 3803 - DNA, 4000 bp, Homo sapiens
  Genbank Accession No. X79981
gcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagactccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatgcttattaaaccttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagatcagaagacgtctccccttctctgcctcacctggtcgccaatccatgctctctttcttttctctgtctactccttatcccttggtttagaggaacccaagatgtggcctttagcaaaactgacaatgtccaaacccactcatgactgcatgacggagccgagcatgtgtctttacacctcgctgttgtcacatctcagggaactgaccctcaggcacaccttgcagaaggaaggccctgccctgcccaacctctgtggtcacccatgcatcattccactggaacgtttcactgcaaacacaccttggagaagtggcatcagtcaacagagaggggcagggaaggagacaccaagctcacccttcgtcatggaccgaggttcccactctggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaacaaaaaaa

SEQ ID NO: 3804 - DNA, 2008 bp, Homo sapiens
  Genbank Accession No. X80198
gcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaattt

SEQ ID NO: 3805 - DNA, 657 bp, Homo sapiens
  Genbank Accession No. X80822
cgcggggtaacgcggagtagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtgtctcagttaaagaagatgaagaagtcttcaggggagattgtctactgtggcaggtgtttgagaagtcccccctgcgggtgaagaacttcgggatctggctgagctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggtcagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccggggtgtgccccaaataaactcaggaacgcccggtgaaaaaaaaaaaaaaaaaacataaaaaaaaaccatcaaaaaaaataaaa

SEQ ID NO: 3806 - DNA, 797 bp, Homo sapiens
  Genbank Accession No. X80909
cttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatactctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaaaaaaaaaaaaaaaaaaaaaa

SEQ ID NO: 3807 - DNA, 3654 bp, Homo sapiens
  Genbank Accession No. X83228
gtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccataaaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagacccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagagtttgaggagagggagtatgtcgtcttgatccgcatcaatgatgggggtcggccacccttggaaggcattgtttctttaccagttacattctgcagttgtgtggaaggaagttgtttccggccagcaggtcaccagactgggatacccactgtgggcatggcagttggtatactgctgaccacccttctggtgattggtataattttagcagttgtgtttatccgcataaagaaggataaaggcaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcacccaccaccatgcccagctaatttttgtatttttaatagagacggggtttcgccatttggccaggctggtcttgaactcctgacgtcaagtgatctgcctgccttggtctcccaatacaggcatgaaccactgcacccacctacttagatatttcatgtgctatagacattagagagatttttcatttttccatgacatttttcctctctgcaaatggcttagctacttgtgtttttcccttttggggcaagacagactcattaaatattctgtacattttttctttatcaaggagatatatcagtgttgtctcatagaactgcctggattccatttatgttttttctgattccatcctgtgtccccttcatccttgactcctttggtatttcactgaatttcaaacatttgtcagagaagaaaaacgtgaggactcaggaaaaataaataaataaaagaacagccttttcccttagtattaacagaaatgtttctgtgtcattaaccatctttaatcaatgtgacatgttgctctttggctgaaattcttcaacttggaaatgacacagacccacagaaggtgttcaaacacaacctactctgcaaaccttggtaaaggaaccagtcagctggccagatttcctcactacctgccatgcatacatgctgcgcatgttttcttcattcgtatgttagtaaagttttggttattatatatttaacatgtggaagaaaacaagacatgaaaagagtggtgacaaatcaagaataaacactggttgtagtc

SEQ ID NO: 3808 - DNA, 2301 bp, Homo sapiens
  Genbank Accession No. X83416
ttttgcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgctactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttgtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 3809 - DNA, 2402 bp, Homo sapiens
  Genbank Accession No. X83425
agtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcgccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatc

SEQ ID NO: 3810 - DNA, 2058 bp, Homo sapiens
  Genbank Accession No. X83618
cggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattggcccaaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtatatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgcctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagaaaaaaaaaaaaaaa

SEQ ID NO: 3811 - DNA, 1649 bp, Homo sapiens
  Genbank Accession No. X85116
actagttgggaccgcaagcacacaccaccccacctggctattttttttttactttttgtagagatggggacgtcaccatgcaggccaggcatttaacatttaattggtaactcttcactccaaaatgaacatgggttgtatgttacatgcatgtttgctcaatgggcatgcgtcaggaccaccctcatgaatattcatagctcctcctgtcacctgctgaatatgcatgtctacccaagctgttcagcataaagccgctactccaacccctcctccaacgaaatgcctgtctctggtcctggccattctccagcctgcggaatggccaccttgcaggctgtaaccccttacaagaaataaagtctcctctcctgtttttttgttttttgttttgtttttttgagacggagtctcgctctgtcacccaggccatctcggctcactgcaacctctgcctcccaagttcaagcgattctcctgcctcagcctcccaagtagctgggattacaggcgcgcgccacacgcccggctaatttttgtatttttagcagagacggggtttcaccatgttggccaagctggtctcgaacttctaacctcagatgatctacccgcctcggccttccaacgtgctgggattacaggcgtgagccaccgcgcccggcctcctctccttttccaaatttatacattttgattttcttaacacacctcactcgagttcgttcacttcggctgcggcgtgatctgccggccctctcagctcaggctgacctcagcgccctcacttcggccacttctgtgtccctcagtcttctcccctcaactcggacctcgcgccctcatgacagggcgccattttcttccctctaactcctcagcccagaggaggcgccttggtcccgtacctctgcccggcaaggcgacttttcttcacttgcacttttgcctcgggtcatcctctgctgctacctccccactatcctcaccatctgctcacgtcccgtggcttccgccctcccttccggtgcagggccccggcctcatacccacagccttgggggctctcgcccctcaggccacgcccctcaggccacgcccctcagcccacagaactagcgggaagtgactgcgaagcagtcgcgccgtggagggacaggagggcggggattgggaggtgggtcctcctcgatcctgggcgttgattggccaactctcacgagggcgggacctcgattgggggcggggcggcaatctgggtcttgtgcctctggctcctcagggcattcccggcggctccgggtttggcaacgaggacgggggagtgcgactgcgtctcgggcagcatggccgagaagcggcacacacgggactccgaagcccagcggctccccgactccttcaagggtgagtcccgcgtcccctgaccctcccccgtggaccgagcccccgcccgcagcgtgcgctccgaggtctgacagccgggctcctggccagtctccgctgcttcgggctgggcgagatctcaaagccgcggctcctccctagtaaactgagcatcacgaaccctgtttggcagactgaggtcacgatggaggggtggcgggctgccaacggcacgtttcccatcgcacgggccctggttatct

SEQ ID NO: 3812 - DNA, 2296 bp, Homo sapiens
  Genbank Accession No. X86401
atgataaatttaatcccgtttcagaccttgaaggaagtaattttgaagttattggcaacatacatcaatattctaatttattagttgatgacaccgaccgtatcagtcctgatgacatcggcaatgatattcatgagtttttacacggaggagataagtgatggctgttgaatatgaaaatggtggtcatggttacgtggaacatgcatctataggaggcgttattgtacacgtgttttatgcagacgataaggaagaggaggataaataatgttagataactttgttgaattgaaaaataagtatgccgatgaacttggaaaccgtggtagaaagtgtgatgagatgaaattcaccagcgaaaaagttaatgaattgatcggtgttgatgaagcgtttaaagttccaaacaagttaatgtcaatcatgatgaatcgtgaacaacgtgagcaaacgtttaaagcatttttggaagttgagcgtgatacatcattcgattggttccatgaatattttgaagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagccggaattctttt

SEQ ID NO: 3813 - DNA, 1838 bp, Homo sapiens
  Genbank Accession No. X87212
aattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgc

SEQ ID NO: 3814 - DNA, 198285 bp, Homo sapiens
  Genbank Accession No. X87344
gatcaggctctttctctctgtaaacctgctcccatggcattcttttctgcttcaattcagtccatccctgaccacccacccagccacccatgctggaaatctgagatatctttgactcctccaccttcccactcccacagctaatcagtagccaaaccctttagattctacttcctaattatcttgatattctatctcctctgcctcctctaattatgacttaattcaggctcttattatctgtcatttaaattattgctgtattgctacaggagtggtgtgtatatgtgcaactgttcatcttggtatgctatagactcttgcccagcagttttgcctcaattctttaaaagctccagttcattgtttgaaatatcaatcagaacattttttccaaaatgctaaaatgattgtcattccccagttttaatatctctatcatctgctaagtaaaagcaagctcctccttgtggcgtagcagggcccacgtgatctggcccttgcccgaatttgtagcttatcacaacatccttctaccccccattacctcctattatacaggaacacccaagcgaccttcacaacattcatatcaactagtacacagggtctccaaagaggacctctggatgcctgtgatctttgtacttctgcctaccctttgccctggcgtgtttttctcttccttcatgttctgctggccaaattgtttttccttcaagtcttaggagcctgcctgattatgttcctcctattccgcatcctcataaaattactgcgacttccaaaacacttggcacattcttatttgaatacattacattgttgtgtaattatcccttggccccctcccccagcactagactctaagctctttgaaggcagactatgcctattcatctttgtatttctagccctgggcccaacacccagaatttcttgtattttcaatatatgtctgccaaatgaattagagctaatgcctgaaggagaataagtttttttgagaaagaggaagagccaggagggaggagaaggcagggtccgaagagccctgggggtttacttggggaagatgcggttccccattgcagcattctgccaggaggtggcactgctctgaagagccagctggtcgcttacagactgaggctgacagcttgaaaccaaagagggaactccaccaggaagcaacattcctccactgggcttcccagcccagttacatgccatactctgccctggtcaaacagccaagtcttcaggaggttactggccccaggcgtctccccagtgactgatgatgttaaaccctacgcttctctgattggtttagacaaaatgacaagggcacctattggaaatgatctggcaaaacatgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaaggtaagatggtactcctatttacttccatcctgaacctagggagcccactcagctttgtgaggaaaagcgctgtgctttgtgagtggtgggaagtcttatgaggcagtggaaacaacaggggagtggggaaagacagctgctatgtgtggttggtaaacgatatcagtgatgctttgcatgttccatttaagacaatctcttgaagcggagattgttctctccattttacaaatgaagaaaatgagactcagagttatttgtgcaagttcacaccattggaaagtggtagagctgggatttgaacaaagtgaatgttattttcactcctccactcaagattctactctgctttctatcattaacttatcttgtgattcttgaaaagtgtcttagtttccttctctgtagaggatggggcagaatggaagaataatctggaagatccctcttcctccaaatgtctgtttttctgggtattgggttaaaggtttcctgctggctgagcgattcctgccaagagcttcaaagaagagggattattttatgcagttatggggtcacttctcccattgctgtctttgggaggcctggtaggttaaggaacagaagacattttgagagacgcttggtgccaatgaagtggctgaagaaatgtctggatacaggttttccaatttaccatttgtgtctggggatagtgggaggcagtcccatctatggcttggggaggctgtagccattcctcctctttcccttctaagagtgagaaacccatccatggccttctctagtcaatacagtggcctggtatgaattagacaaaggaatcccctttgggaggatacagccctatgccaggatgtatggcatggtgagcagaatgcaggctttcacttgcttctttggctaggtgtctttgtgcagcccccaaacacacaatgaacagtgactctgaatctgtcactttattttatatatatacatttttaaattttttatttgatttaatttattttttttgacacggcatctcgctctgtcacccaggctagagtgcagtgacgtgatctcggctccctgcaacccctgcctctggggttcaagagactctcctgcctcagcctcccaagtagctgggattacaggcgcatgccaccacacccagctgatttttgtatttttagtagagatggggtttcattatgtttgccaggctggtctcaaactcctgacctcaggtgatccacccgccttggcctcccaaagtgctgggattacaagcttgagccaccgcgcccggcctttatatatatattttttgagacgggctcattctgtcacctgggctggagtccagtggcacaatcatggctcactgcagccccaacttcctaggcacaagcaatcctcctgcctcagcctccagagtagctgagaccacaggtgtttgccaccacacctggctaagtttttgtattttttgtagagacggtctcgctgtgttgcccaggttggtcttgaactcctgggctcaagcaatctgcctgcctcagcctcccaaagtgctgggattacaggcatgagccaccatgcctggcctgaatctgtcactttagaaagtagaactctttacttttgccaactggcctttttataggcaggggaagcttggagagatgccataatttgttcttcaccccctttgggagggggagtctaaataacagacacaggaaagggtctcacctcagcccacgctccttaagcaggccttgcttgtttttgttgttttgttttgagacagagtctcactctgtcacccaggctggagtgcagtggcttaatcttagctcccggcaacctctgcctccctggttcaagcaattctcctccctcagcctcccgagtagctacaggcgcatgccaacatgcccagctacttttttgtatttttagtagagatggagtttcaccatgctggccaggctggtctcaaactcctgacctcatgatccacccaccttggcctcccaaagtgctgggattacaggcatgagccactgcgcctagccccaccttgctgttttttaagttggaggagaaggctcccacctccctgaacctcaccctgtgtcctttgcagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagaggtcaggagttttctggggagtgaagggaggagggctgcattaacctcattgatctgtacactgaataattccccttgataccagctccccatctcaaatactttctggttctcttcatcaccttaatttttccaccagccttggtctgcaccctgtgttcttttggtgggccgaagtacctagcatgtagtaggcattcagaactatgtattgaatgtgatgaattcaacaggtaccaactgatacctactgaatattaacacttgtgctactatgcccagcaagatggatgggaagagtggaaatatctgatgacgtgactatgtcttagtgagaagacagtgcatggttagacatcaatgtgagctctagacaggaagtgctgaaggaagtcatggtggaggggtccagagtagcctggatctggctctgcttctacgtctagctgcagtccttgcctggaagaagacctcccttcagagcccagctcctcgctcatctctgtctcccaaagcctgacccactgtgttcttctctgccctcccctccatatgccatggcccctccaaacacagagataccatctaaactagtctctttttccccctacacttcaatccccccaccagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattggggtgaggctttctccctggaattctggtccttttgggggcaaaaagggatagatccatgggaggaggcttctttctccactggtaccttgtttagtccattcctaccctaagcccatcccagtctcccatgtcatcccagacacccacgtcatttccctgggtgggaggctccctaactaggtccccaggctgagccactcatttcctccagtaccccggaacgcactgccctcagatctgctggagaatgtgctgtgtggcgtggcctttggcctgggtgtgctgggcatcatcgtgggcattgttctcatcatctacttccggaagccttgctcaggtggtatgtcatctggagggggcgggtgagcctgtgggagccagatacagtggtgcatgcgtgcatgtgtcaggattattttgtggcatggggggacatatagcgatcctcaggcccttgggtgtgggggcctgtatccagcaccatgggggcacatcttcccagttggggacccagttacacacacacagttatgggtcacaagaattgctttgagtgaaaaaaggaatcatggggtgctgtaggaagggtgcttggagatgatttgggaacaaggagagatcaacttctgcagggtgtggtgcaggcagggcgagcaaggcctttgtgggggaggaggaggaggagaaggaggaggaggatggatcccctgatgcctttcctccatccctgtctctcccccagactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatcagtgtggcttctttcttaactcatggtatttgtttctggatatctcaacttgagtgggttgtcgtttcaaattcagcatgccttaacctgaacacagcttgacctcgttagggagggaaatagggaaaacccctaatttgccagctgagctcttattccctggtcttggcggtacatgatgtttttccatctatcggtttgtgcaaaatatgtgagaaacgaaggcagagttattttctaataatctgcttacaaaatggttaaggaagctgcttgtgtgttttgtgcgtgtgtgtgtgtgttgtgtattttactgtttgtgaaaatgtttatgtctcgtataggctgccctgaggaacatataactcccttcaaccctcaccgtaactgagaaacagaagctcagggatgggaagaataagctcccaagtgctataccaatcagttatgtcagttctgggaaaacagtatcatgaagcccctaacatgaagtgaaaacagcctggaagggcaaagaattcacatgtctttcctgacaatctgttccttggcctgagtgaactgtccaaggagaactgcacaggtgctgtcctgggaagataacgaaaggtggcagcacatgaccactggtggtaaattgctttgcatatgctttctttcttgcattccttagggtctgggagttgctttggatgacagggtggcaataaagttgagagggcaattatttggtgagggagtttctgttcttggcattgtactagagtctaatctaaaagaaaatattaaattctccctaagagaagttgcactgtctctgaaccatctcatttctaacagcatcatgtgtaccggttaagaagcatgggctctggaacctgactgctggggattcaatcgtaactgtcagcgtttagctgtgagcccttgggcaagttacttaacttgtgctttggtgtcattttctgtaaaaggatgatgataacaatggtgtcccccttaccactctacacccaccatgttgccaacatttgaaagtcaaataagtattagcgaggataaaggaaaatgtgaactgtaatatcttggtctgttggtgggaatgtaaactgtttatgatgcccgaattacagaaattatgaactagttgagtgaaaaagttaatataggaaataaggcagcatatcctcatgctgtgaagcttaaataagttaatacctacagaatgcttaaaatagtgtttggcacatagaaaatgtgctgaataaccctaacccttatcattattggtcttgatcttcagaggagaacttagttgcctcgtagacttctttctcttttctgaaaatatacctcaatactagcttcaagtattgtattttctccattttagatgtttttctttttattctcatgttagtaattctagatgtggtgctttctagttcttcctaatttctctgtctctctgttttccaacttatctagatatttcctgtcaggcaagacttaaaagtgctttattatgctgtgtgactttagacaagtcacttcccctctctgggcctcaaagtcttcatctgtaaaatgatgggcttagattagatgctctctgatgaaaccttctatgatactgttacttaagtactctagaagcactcaggtatcctctctagtctggtgccccttttctaatatactatattacgcactattcccagcaggaatgctattcttgtttaaatcttttttcctcactcttccttgaggtattatatctgattttggtttagggcatttgcccaggctctttcctctcatacgggagctttctctattctgctcatcttgttcctgtcttaacccactccataggtccaactccagttcaacttattccatgaacctgcccctaatttctctttattgaaatcttccaagacttaaagcactcaacctaaggattgggatatgccgctttatttcctatgttaattttttcgcccaactagtttataatttctataattcagggatcataaacagtttacactcccatcaacaaagcaagatagttcacatttccctttatgctcactaatgcttgtaattatttgactttcaaatgttggcaacatggtgggtgtagagtggtattttgttgttttaatttgcttttctctcattactaatcagtatcatattgtttgattattttggctttttaatatgtgttactattaagaagaacaagtctccattccttcaccaccttcccaaaaaatttattttccttttctttatcaaaatatcctaaaatactcttggactttatttccttgtacattcataatcagttgttaaattctcctgaaacctactgttactttaatttggggtagcatttaggttagagatgtggggagaggttgtcattatgttagcatggcctatccatgaatatggtatatctctacacctctcaggtctttgtgcacttcaataaagttttcttttttcttaaaattcttatatttgatatgttaattcataaatatgctatggtttttattgttattataaatagtaggcaattttcagttattttccaattgattattggcaatacaggatttaaagtaataaatcctgagttcaagtaatggttttattacttagtatctgggtaaatctgggcaaccacttaacctccctctgcctccattttctcgtgggtaagatgaagatagcattcttcaatagttgtggtggcaaaaaataaaattaaaaaaggaaaaatagttgtggcaaatcagatagactatccctagtagttcaaataatttgactgtaggttggaaggatggtgaactgactacagaaactataatccaaaggtcagggtctagagcagtgaatcctgacagggtaggagggtgtgtgtgtgggcggaggtgaggtaaggggtagatggcaggggtggggtggggattggacagattgggcaagtaatataatcttggcaggatgtaggtgtgtgtagttttgaaaagacactgaagtcacgaatgtggtcttatgctatgaggcgtgattaactggttgagcaattttgtgtttataaaatggagacttcagttaaaaccgtctgccccaagaacctgcgaactgacatggagcaactttaggaagtgcctagaagagatttattattatggccatactctcagaaaaaaacaagaaatcacatttgtgacttcctccaacgtgcagtgccagtgacgttattgtagcttgtctttgttttagctaacccaggctctcgtaggacacctcctccctgatggcacctcacagcattgtcaagcttgtggagctatacaccagacctacaatgccaactgccttcctcctctccaacacaaatccagcccagtattcaaggctcattccaggccctctcgactgagagtactccctgtctaccatgtccatggtgatttctctcttctcttttaagaccactggccttattgcttacttactttaatataaactatttaaagtgtttgttctcactccccaattgacgtacaagcaaagcgatatgggggcagaatccatatcttctcactctgtattttcccagtaatgctttgcacacaaaccctgggactagtttactgcaggcatgtggtggtcaggctaagggcagaggcaatgggaaaggagaggactcactctttgggtggttgtgtagaggcaataaaagaaaggcaacatgtgggaacctggttggggctccatacctcttcggtcccggtgctatatcaataattaacaaataagtaacaatggacagagcaactgaaatgttattttgaattggctagaggtggaaagacagagctatatctgtaaaaatggaagggttgggaggaggagaggaaggaaaacactgctgagcacaggtgtctgggttttctgtccttctttattctaaaaagctccctcagtgtttgaattaatagagaagtgaaatcctctcctaccatttcctgttgtggcctcacagaaggtttcacatctcctttgactgccggagcagagatctagacataagagggaactacattcagccccactgttactggctagggccatgttcagtgctggcacaggaccacacagccagtgctcccttgccagggctaggctttgtagacattgaaaaggatcccaggacttggttcctataaggttaggctaacagcttacctgggcaggatggggaggaatgtgagggggaaatgtattgggggggtgtgggggaaaattcagttttgaaacttgtcaaaagagaaagtggaagggacggtggttctcagagcagaaggaactctgaggacaggaaagataagacttgggtgaattgggttatggattgtgactcttctctttctctctttctcagcggaggcctcactaactccctttatttgagccatcccagttccaagatgtagtgagtgtgtgggcatgctcaagagagtgtgtatgtgtgtgtgtgtgtacacacgtgcatgtgtaacagctgtataagaagaggagttacagcctttagaccttgggtgtgaatctttggacctgttttccaacctgggaaatgaggacaattaacaagttttttttttttttttttttttttgagacagtctcattctgtcacccaggctggagtgcagtggcacgatctcggctcactgcaacctccacctcccaggttcaatcgattctcctgcctcagcctccagagtagctgggattacaggcacgcgccaccacacccagctaatttttgtattttttgtagagacggggtttcaccatgtttgccaggctggtctcaaactcctgacctcaggtgatatgccttcctcagcctcccaaagtgctgggattacaagcgtgagccaccatgcccggccaacaagtcttttaagatgagatgagatattatagaaaggacctacctagcactgtatctgtagaagctctacagattatgcactccccaccccatattctgcccattccaacacacttgacagttcgttagcagagttagagtatataagcaaggtgagtgggggcagtggctgggagctatggcagagcttcagttaatctcaattagttacacaacgaatctttcgtttttggtaataatctttgtatgcattttttatccccattttcttcataggtgttagattttcctgagatcagggactttgagggagggcaggtaagtgtggtgtcaaggggccccttccacaatcctgttttgtttagctcactatttaataaaatccaagagttctcagaaactaagatgtgaagaggcagccctgaaacctactggggagcagaaggaagccaatttagagtttcaagttagtgatggaaaatccatcaactgtatagttcacaatgggatagaagaatgaattgccgtttaaaatctgctttttcaggccaggcacgatggctcatgcctgtaatcctagcactttaggaggctgaggtgggtggatcacttgaggtcaggagttcaagaacagcctggccaacatgatgaaaccctgtctctaccaaaaaaaaaaaaaagacaaaaactaaccaggagtggtggcacatgactgtaaccccagctactcaagtggctgaggcatgagagtcatttgaacccaggaggcgaagattgcagtgagccgagattatcccactgtactccagcctaggcgacagagtgagactttcaaaaaaaaaacctgtgaaaaaaataaatacgcaaatacataaaatctgccttttcaagacacacacgtgaccaagaagcatatgaaacaatgttcaacattactaatgattagaaaaatgcaaatcaaaatcataatgagataccgtctcacaccagtcagaatggctattattaaaaagtcaaaaaataacaaatgttggagaggttgcagagaaaacggaaggcttatacactgctggtgggaacataaattagttcagccattgaggaaagcagtttggcaatttctcaagaaccttaaaacagagctaccattcgtcccaggaatcccattattaggcatatacccaaaggagtatacattgttctaccataaggacatatgcacatgaatgctcactgcagcagtattcataatagcaaagacatggaatcagcctaaatgcccaccaacagtagactgtataaagaaaatgtggtacatatacaccatggaatactccacagctagaaaggtcgtgctcacgtcttttgcagcatcatggagctgggggctgttatcctaggcaaacctacacaggagcaggaaatgaatactgcatgtctcactttatagtggagctaacatgagacacatggacacaaaaaggaataatagacactgggccctacttgagggtggaggatgggaggagaagaggatcaaaacactacctatcagatactatacttattacctgggtgatgaaataaatttttacgccaaatcccgatgacacacaatttacctatataacaaacctgcatgtgtacccttgaacctaaaacaaaggttaaaataatttaaaataaataaaaaataaaatcttacttggtattctcaaaaaataaaaaacaaaatctgtcttttcaggggaagaaaagtaggaaagctttatctcattttcctagtggcttcataatgcagggacctgcccccagggaacagggtatagtaggggaaacacacaggggtgtttagagtttggcgaaaggcaggtgagctctgggcactgacccgtcaccagctatttttcaaggagtctgagaggtgttaacctgcggtctaccccgtgagattgctcagagtgtaggaggatatggtttactagctccggaaagcagctattataactgaggaggaaatgaagcttgactggctagaacagaagcaacaatggaggcccatggagggattttccaggcccctattcctgatctccatggtggcgctgcttcccttattctgcagtcttgctttgagaccagacaattctgtactctgtctgtgccttcttccttctcagcagccctgcctctgccacctgccccagaagggctctgggtcctctcatctcaggacagacaagggtttttgtaattatcttcttgggtaacctccctgtaaggaataggagaggttatctggtcctggtcttttgggagagcattgagaagaaaaagttaaaccagtgggcagcccaggctgcatacatcctgggaatattgcgattattctctccagtaatctacggaaatctactggttgttctgcagaaaaagaattaagagagacaaggagacctgttgtctaagactaaggcaggatgacgtttacctagtaactgatgatgctaggctgaggcactcagtgatttgtctctacatttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtaaggacacttcttctggggactctcccttcccctgctcctgtttcagggtaagggtgttccgttttgtaattgcatttgacaccccagatagtttgtctccctggtatacattcctatagcactttgtactttgtagcaattttaatgtaattaatctgtataattatctgtgcagtgtatattccctgctggaatataggcaaggacaatgttcatcttatttattgctgcctcctcagctcctagcacagtgccttgcatgcagcaagtgcttcataaatatgtgcgaagtgaatatttaatatttccagcacaatacaaggctgactctttctcttgaccctttttctctctcaataatttgccttactgaaggtctgtgttctgggcaaattgtcatgtttaaacatgcaaataatctcggggggctactcctatccctgtgcttagtcttgcataaagaggagactggatctaaaaacttatctactacttctactgactccctcaaatcagactttcagaaacttcagtgtatgagcttggtcagtagatgttccctgagcaggaaatctgtgccagactagctggatgtcaccaaggcttaggttctgagctgaatataggaaaaatcaactttttttcttctatatgctcacactcaacacttctttgaccaactgtgtgaggttttttttttttttttactcataccaaccaattctcctatattagctggatatcctataattcaattccattgtgacattaactagagttaacatagacaccaaaggttaaagactcagtcccataagactgcctccatttcagacaccaatcacaagtagtaggttcccaaattacccacatcttctgtccaacttgcctacaaatcagaggttcccatgaccccctccttggggttggtaatttgctaaagtggcttatggaactcaggaaaagtttacttattattgtagattttttacaaaggatattttaattgataataataattataaatattcatggggtggataatgatgttttagtacatgtaatgtacagtgatcagatcagatcatcatctcatttatcatttctttgtgttggaaacattccatatccttcttctagcgatttgaaatgatataaagtattattgttaatgacagtcatcccacagtggtatagaacactagatcataattttgcatcctttaacaaaggatattttaaagcatacaaaggaacatccagatgaagagataccagatctggaagggtcccaatcacaggagctctgtccccacagaattggggtacttcacctcctggcatgtggatgtgtttaccaactgagaagttctctgaactccatagttccgggatttttatggaggcttcatcatgtaggcatgactgattattaactcaatctccagccccttccccttcagggagtatgggggatgggactaaaagttccagacttctaatcatgacttggtctttctggtgaccagcccctcctgcaggagcccaccaagagtacctcattagaacaaaagacactcctgttatctaggaaattctaagcgattaggcactctatgtcaggaaccagggtcaaagacaaagctctgtgcagagctcctaaatatacgtctgtatgttttatatatttattatttgtgtatatttattatttatatatttatttatttattgccaggccagtagaagacattgacctgttctcccttccctggctcctctaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacgtgaggagagaggggtgcagaggggctaccaggaagtgcagttaggagggcaggccagggaggatcccacagtggcccaggggtttgagatttgagcagcaaataagagaaaatgtgtggatctgaaatgtagaaagacggaggattgaacctcaaggggaacaaggtggctgacgtgagtggaacaggagtaaagaaggggaggtgaggcttgaaccgcgaggtgccatgtggggagcttatgcagaggctggggcatctcaggatgcatacccaagatgttcttgccttgttatcccagattttgatgttccagatctgatgtgggcccaggcatgggaatatttggaatcccaggggattctgacacatgctttttctcacccttaaactcttgcattgacaatggcttgaagtttgtgaaagtaaacttgaagatctccacagtacagaacagtgtgtctcaagggtggtttctgaaccacctttctcagaattgcctggaggaggtgcttgttaaagatgcaagccccttagtaccactccagatctgttgaaagaaagtatctggggatacagcctaggaaatctgcattttaacataattccttggatttttatttaagattgtgtttgaaaaatgtcaagatagaggcaagcaagaggatcacctaggagagtaaattagtaaaagatggcagtattagcaatctctttagtttgactacattcattccaaatttaagagtgagtcctaagttaggcttgtttccttgaactatgtgaggagaaaaagctttaactagcaaaagaacgtattaaacaagatttggagaaaaattccttttccaccttaaaaaaacccaatgtacaactctggattactcttagcttccttatttcaaatactttccagtttatgtacttgaaataaatacaacaacttctagaacagcttgcagttcagatctggcttttactaattgtaatcaaacataattctggaggaggaaagaaagaaaggggcaatgaaggaatgggagagaagaaagagtaatgcaggaatacattctaacggttccccttcaaggggcagcatggcagagggggctggggtggaaagtgggttgcaaaatctacgaagagttgcgatagggaagaaaccaggttgaggaagcagccagaatgtcaccctccttcctaaacatgtttttttctcctatgcagggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagtaagtgtatggcagatggatggaattagggtcaaagcagagaaaatgagatgtggatcgatacatggtacatggtagacagcgaagtgctgaaaatggggactgagtctggaggaacttacggggggcttaggaccagaatggggaaatgggataaagaaatggaaatatttaggttggtgcaaaagtaattgcagtttttgccattactttcagtggcaaaaaccgcaattacttttgcaccagtttaatatttagtctgtgctattgctgctctggtggtgtggttgatgttgctgcgtctatgtttgagggtgagaggggagcgtgcttgctttgaaatgaggatgtaaatttggcaatcatattttcagaaccccaaattgtaatacactattctagcctccttagatttcaactattctggtgccagaagcagatgggagctgaaggaatgatgaaggttgaagaaggggggcttttcttggtgtggggcagtactgcatttggcctgctctaccaagcatacgggagtagtaaagccacggctggcagaccatttggcatgcatgctcaggggccagtggataaagaattacttacagttcaaacactgtttgaactcagtgtcgggagtagttaaaggtatcgtgagaagttgcacacagctttggggactcttggaaaagaaagaggaagaaatgaggaagaggaagggtgtctacaaagggccagagaacaggatctcagatcagctgctgtaaccaggtttccccttgtgggaagtgttgtttcttgctgggcagttgggaagggaatggagaacagagaagagagtggaaatcacatgctcacttgaactttcctggggaacgtctcctcacagcgtgcacaagagcctccctttagaaatggagtgttcattttatcatgggaaaagaatctgagtgggacatgattcagaacaggaccggcccaaggaagtgcaggggctgtggagtgggatggagacaagctctgaaaggacacatgggagatctagatgtagaaggtacacaagtagtaggataactcacaggatggatccactggaggttaagacatgtggtaagacagtgtaataggaagctgctcagttggagaaagtaaggaagcaaacattgttaccgtgggggcaatggagaggacagtgaggagccctttatcctgataagggtggctttgaggtaaaggaaggaaagaggatgccttgagaggccccactgtattagagaggacctggaagccaggatgctaattctggggagatggattccccaggcttactctaggagtagaggtccatgggacgagggtttgatttgagaaagatcattttcttgggagtgggtggtgtgagctagacccttggagctgggataaaggaccttttaacccactgagaggtggctgcaataaatggaattgccctgggggtgagcaacagaaactgggtcaagtaagtttctattttttgcagcacctgggctgtcccccatgcagaccctgaaggtttctgtgtctgcagtgactctgggcctgggcctcatcatcttctctcttggtgtgatcagctggcggagagctggccactctagtgagtgactcgctgaactcccatccccactcttggtcccactctctgcttactttctgtttgtgattaactctctccttcctactgcatttgctatgaatactgctagatattttcatccacaaagactggtataatcaagtatcttcctctcttaggttacactcctcttcctgggtccaattattcagaaggtaacatctctgttggtctgtttccctacttgccctttggtaggggtgcgggttagaggggtcagtgttgggttcaactaatcttgattattatatgggtgagcttccatgaggatctaggcaagggcatgatttaagctgccattgctaggattaagagcaggaaggagcatcctcctcttctaccaagtgggatgtctgtggagaggaggctgaaggtgcttcctttgtattagttgttggtgccctggagttttcagtatcactgtattaaggcatgggatggttacagtgacaaacgatgggggcaagttgggttgaagcctcattatctcccttttatttattctgtaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtttttccatgtcttcttcctggggccctggggaaggaatatgggcaaagcagggactgaggttaattctcttctgcttgagtaggggagaaatcaatgccttcttccattttcccacttagacatgacagaatttggggccgttttctgatttataattcataaggagaaattcaactgtggtgggttggagtcacagagtatgggcaaggaagggaattaacagcttactcacctcatacaggatcttatgaggattaaatgagttcatacttgtaaatggctaagaacaccgccaggcacatagccagcctgcaatagtgacgttagctatattcgattattcaactttctggccaggcattgtaccaggtgctttgatcctcatcacaaccgtaaggcagacccctcatacccctcaggattcaggggacagagcttaactccagattgagttctagacagttatttcttccataccctgaatgcagaagggaacatagcttgagtgattattatgtcttaggcactggtctcagacctttatatttgtagctcattctcttctcacaataaccacacaagggacagattgtttccctctatgttacagacaaaagatgtgaggctcagagacatttaagtgacttgtccaaggtcaaagaacagatttctgtaggatgtttgtctacctgagctggaagtagcagattactttattctgaagaccctcatgctggtgagcacacatctcttcagagccaccgttccattcccttctaccccaagaccaaggagagccctttgggggaatggactccaccctaaggaagagaggatgctggctggtggtttgttgtcccacgaagggcgacacctgctggacacagaaacctagggtgtggaattgtttttggaattagagctagatactagaatatgggtaagaaaaagaaaccaagaaatgagttgatttggaacacctccataatttcttcagaagcatccttggaattagagcatctcttctggaaggggttaacagaagaagtcagtggaaggaacttaatctctacattttaccatttttatgtttcattttcattttttctattcactgtttttgtttttatttttgtttgtttgacaaagcaaattccttttgaaattctagtttagtctaggaatggggggctttgggccttgtctatatctgggcagttttatttattatttttattttatttatttattttttttcgagacagagttttgctcttgttgcccaggctggagtgcaatggcgtgatctcggcttattgcaacttctgcctcccatgttcaagcgattctcctgcctcagcctcccaagtagctgagattacaggcgtgcaccaccatgcctggctaattttgtattttcttagtagggatggggtttcaccatgttggtcaggctggtctcgatctcctgacctcaagtgatccacctgcctcagcctcccaaagtgctgggattacaggcgtgagccaccgcactaggcctatctggacagttttaaaggagaagctgcagatctgaagggtctagttctagtcacagcagtgggaatcaaagtggcaggatcccagagaaaggaagtagagagttagctaatgggacggcttccagttccttttctagagatttccagtgcaggcttttctctgccctaactttgtaggttttttgttttataggaaaggctgtccccttccaggtaaggaatagggaaaagtatatgtaggtctgctaggatccagaaagtcagaatactataggtagaaaggggagttcttacacaggggaatgagtggtacttgaaaggaaggtggaagaagggtgatggtgcaccaattgtaggaggatgaggagaagagaatggatgctgcatgaggagaatggaatgtaaacataatggattgccaaaaaaggagtgcgtgtgtgtgtgtgtgtgtgtgtgcacttgagcacatgtgagagaaagagaggaaaaaaagagaaggagtggaagagagtaagagagagggagcaaaagggtgagaggagagaagtggagtgggagaaagaaggagagggacatagagagagggagggaggggagcgggggaagagagagagagctggactttcgggttatacataatccaagctgcacaaagaattgttttcgcccttcaatgtcttgttgttttaaaagctgaacttggagctagaattggttttaaaggtcatctagtccacctcccctcccatgaaagaactgggcctgtgttaacaagggcacacacagtgcagggagttccttcaacacttggggcagataacaatattttagagaaacgcgttgaccccacatttgagcttcttcttttgaccattaaagacaatgagaataaatctcaaatacaccacgggaggtggtatccttggcattttttttttccctgagggagagcatgttcctaggttccaggttctctttgcctccctacccacgaacacatgcatgtgaaagaaacagacaagattgacatttaatcccaatgtctatttatgaaaattatctttaggccattttctcaagtttttctctttccaaagtaaaattgggcaaatcagatgaaaaacgagggtggagttcaaccccatcctcaaatccttttttttttttggcttgagtgtctgtcattcccaagagccctccaactgccttgaagcaaggcatgggggatttctccgtggtgcttcctgccactacttggccagaccagtctccaggggtttcagagagtggagaggccccaaacctatagagactactcccagatggggggctccttgtttctccagacccttcctcttccatttcatatgaggcttccaagaggcccctggccgtgctggtctggggcagggaataaagaaatggcttttattgtatcagagtctcaacagaaaacagatggcatactcgaaataggacatttcaaggaaagtttatttattagcaaagtatttacaaagaactgggtggaggatagctgttactaccccaaggtccaaagaggccggggacagaaggggttatcaggactcagaaggacagcaagccctgtacagtcaccaccttgccaagggcagtgcccttcagtcaagggacacaacagcttaaggtgaccttgtagggaggaagccaagggattagaaacactgacctcactcccctcttccctctgctcttaggctgatgctggaagcaagaagaagccagggagcatgggagccattcaatgtcatgcaggtcagcacctgaggcagaccccaggtgcagaagtattgagagtgggtccagaaggacagatggaggacaggaagtacattcacaacaagaaggaaaaacgtcaatgttgtggggtggagagagaggtgcaaaatctgggcttcttttggccttggacaatgacaagcgcatagtagcaacagaaactaagtttgtagtttcctactggggagtttgggaggacactcacttctagttctgtcttccccacttgaattttgattgtggttatactgaatttatagaaatttggggttaactgacttgtttttattactaaatcataccatgcaaaaacaggatgttttctcatttattgaaatcattttgtttgctctttattatggtttttaaactttactttttcatagtagtcctgagtatgctcagttaattcttaggcatgttgtagcttttgctgctattgtgattggtatcttattgcaattctacttttgaatcagtaatttctgatgtagaagaatgtatctaatttaaaaaattgtggttaaaaaaataacatttaccgtcttaaccactttgaagtgtacagctcagcagtgttaagtatattcacatttttgtgcaaccaatctccagaactccttttcaccttgcaaaaccagaactctacacccattaaacaacaactcctcatttctctcttcctctagcccctggctactatcactctacattctgtttctatgaatctgactacttcagataccctgtacaagtgcaatcatggagtttttgtcttttggcgattggcttatttcacttagcttaatgtccttaaaattcatacttgttgcagcatgtaagagtgctttcttcctttttaggctgaataataagctactgtatgtatatgccatattttgtttgcccattcatctgtctatggtcatctttgttgcttccacctcttggctatcgagaatagtgctgctatgaatatgggggaaaatatctgcttaagtccctgctttcaattcttttgcatttatacccagaagtggactcttgggtcatatagtagttttactactgattttttgaggaactgccgtactgtttcccatagcagttacacattttacaatcccacgaacattgcatataaaggttctaatgtctctacatcctcaccaacacttatttcttccctccctctctcccttccttccttccttccttctttcctttcctccttcatttgctccctccttcattccctcccttctttcctttttcctttcatttttatagtagccatgctaatgagaattagatgatgctatggttttaatttgcacttctctaataataagtaatgctgagcatcttttcatatgtgtgtttgccacttgtatatcattctcgaggaaaaattgtctgtttgaaagttttgtttgccccctttttaactgtttgtataaacaattattgttgggttttatgagttctttacatattctgaatattaaccctttattggatatatgatattcaaatactgatatatgattttcaaatattagaaattaataatttttgtaagttgatcttatatgggacaaccttgctcgatcctcttattggttttagtggggtttttgttgttgttgttgtcattgttgttattgatattctctctgtctctctctttttccaggtagataatagtatcatctgcgagcattgttttgtgttttccctcttaatccttagtgttttatttttcatgttgcttgactaggatcttcaatgctgtgtcaaacagtagggtgataatgagcattactcttaaaggaaataaacctaaatattctcattaagtataattttgctgtatattgtagattcacatgcagtggtaagaaataataaaaacaatcctgtgtatcctttacccagtttcccttgatggtaacattttgcaaaactatggtacaatatcacaattaggatacatggatacagccacaatacagaacacttctatgatcacaaggattcttcaccttgcccttttctagacacacccacttccctaccatcccataccctccttaatgtctagcaatcactaatctcttatccatttctatgactttgtcacttcaagacaaatttttttttgtcattttaaaacaaatgattaataaatggaaacatatagtatatacacttttgggattgacttttttttctctcaatgtatttctctggagatcatacaaggttgttgcatatatcaataatttattattgcctagttgtattatatggtatgggtatagcacagttagtttagccatctgtccatcacatctgggttgtttccagatttggctgatatgaatataagtttttgtgtggacataagtcttaatgtctctggagcaaatgcccaggagtgtacctgctgaattgtatggtggttgcatttttagttttttaaataaactgtcaaagtgttttccagagtggttgcaccagcaatgtgcgagtgattgttttactgcatcctcacaggcatttggtattgtcactattttttttattttttttgagatggagtcttgcactgttgcccaggctggagtgcagtggtgcgatcttggctcactgcaagctccacctcccgggttcgcgccattctcctgcctcagcctcccaagtagctgggactataggcgcccgccaccacgcccggctaattttttgtatttttagtagagatggggtttcaccatgttagccaggatggtctcaatctcctgtcctcatgatccgcctgcctcagcctcccaaagttctgggattacaggcatgagccactgcgcctggcttattgtcactattttttatttcagccattctaatatgtgtgtagtgagatcttattgtggttttaatttgcgtttccttaatggctaatgatatcgaacatcttttcatgtgcttatttgccatctgtatatccttttaatgaaatgtctcttcatgaatttttcccattttctaattaatttttttcaaactgttgattttttttctttttttttctgagatggagtcttactctgtcactcaggctagagtgcagtggcatgacctcggctcaccccaacctctacctcctgggattacaggcgtgtgccacaacgcccagctaatttttagtatttttagtagagacagagtttcaccatgttggctaggctggtctcaaactcctgacctcaagtcatccactcgcctcagcctcccaaagtgctgggattacaggcatgagccagggggcctggcctgagttttgataagttgttatatattctagatactagtccttttttggatacatgatttgcaaatattttcttccattatgtagcttgccttttcattcctttacaagtctttcacagagcaacagtttttagttttaatcaggtctaatatatccattttttcattttacagatcatgtttttggtgtcaaatctaagaacttgttgcccagatctagattcagaagattttcccctatcttattctaaaagttttatagttttacattttgcatagaagtttgtaatccatattgagtcaatttttgcagaaggtatgagtcttagattaaactgctgctcctccttctcttcctccttgttgtctttctctcctcctatggcccttgaatgttcaattgttccagcaccatttatgtttttccgatgtctgcagggtgtgtagggatattccctgtggacatttctatattctttctttcttctttgtcagtgtagtctgctagaggttcatcagttgactgatcttttcaaagaagcaactttttgtgtctcactctgtggcccaggctggagtgcagtggtgcaatctcacctcactacaacctccgcctcctgggctcaagtgattctcctgcctcaaccttccaggtagctgggactacaagcgcctgccaccacatttggctaattttttgtaattttagtagaagcagagattcaccatgttgggcaggctggtctctaactcctgagctcaagtgatccacctgccttggcctcccaaactattgggattacaggcgtgagccacagtgctcggccttcctttcttctttggatgtattttgatcttctttttctgggctcttgagatgagagtttgaattattaatttgtgtacttttttttttttttaaagagacaaggtctccttatgttgcccaggctggcctcgaactactgggctcaagtgatcctttcctgcctcagcctcccaagtagcacccagtttttcttctttttaatgtatgcatttaatgctataaatttccctttcagcactggtttagctgtgtcctataattttttttattattttgaaaatatttcgtgggttcatggtaggtgtatatgtttatggggtacatgagatgttttgatacacgcctggaatgtgaaataaccaaatcatggagaatggggtagccattccctcaagcatttatcctttgagttacaaacaattcaattacattctttaagtaacttaaaaatatacaattaagttatttttgactatagtcactctattgtgctatcaaatagtaggtcatattcattctttctactttttttgtacccattaaccatccccacctccccgctcagctatccactacttttctcaggctctggtaaccatccttctactcactatgtccattagttcaattgttttgatttttagatcccacaaataaatgagaacatgtcatgtttgtctttctgtacctggcttatttcacttaacataatgatctccagttccatctatgttgttgcaaataactggatatcattcttttttctagctaaatagtactccattgtatgtatgtaccacattttctttatccattcatctgtcgatagacacttaggttgctccgaagtcttagctattgtaaacaatgctgcaattaacataggagtgcagatatctctttgaaatactaattttctttctttcgggtatattcccagcagtgggattgctggatcatatggtagctcaattttaatttttttggaggaacttccaagctgttctccatggtggttgtactaatttatattcctgccaacagtgtacaaagccttctccacatactcaccagtacttgttattgcctgtcttttggatacaagccatttttttttgagatggagtcttactcagttgcccaggctggagtgcagtggcccaatctctgctcactgcaacctccatctcccaggttcaagcgattcttctgcctcagcctcccaagtagttgggactacaggcatggcccaccatgcccagctaatttttgtatttttagtagagacagggtttcaccatattggccaggctggtcttgaactcctgacctcaggtgatctgcccgcctcggcctccctcagtgctgggattacaggtgtgagccaccgtgtccagcctgcatacaagctattttaactgaagtgagataatatctcattgaacttctgatttgcatttctctgatgattcataatgttgagcacctttcataagcctgattgccatttgtatgtcttcttttgagaaatgtctattcagatcagctcattttttgtttggactattgaactcttttttcctatagagttgtctgaactccttatatattctagttattaatcctttgttagaggggtagtttgcaaatatcttctctcattctgtgggttgtctctcctagaaatttttgatatgttgtattcttattttctttcaattcagtgtatttttaaatttcctttgagatttattttttgactcgtagagtatttaaaagttttcgcttagtttcttgactttcctctgtcatctttctgttatttatttctagtttgattccaatgtagtcagagaacacattctgtataatttatattcttttaaatttatcaatatttgttttatggccctggatatagtccaacttggtatatgttgcatggacacttcaaaagaatgtatattctgtgcggccaacaagcatgtgaaaaaaatgctcagtataactaatcattagggaaatgcaaatcaaaacaatgatgagacaccatctcaccccagtcagaatggctattgttaaaaagtcaaaaacaacaggtgctaacaaggttgtggagaaaaaggaacacttgtacactattgggggtaatgtaaattagttcaggcactgtggaaagcagtctggagatttcccaaagaagcttaaagcaaaattcccatacaacccagcaattccattgttgggtatatacctaaaagaatataaattgttctgtcataaagacacatgcacatgcatgttcatcacactgctattcacgttagcaaagacatggaatgaacctagatttctttatccagtgctcatcaacagtgcactggataaagaagatgtggtacatatacaccatgaaatactacacagctataaaaaatgggatcatggcctttgcagcaacatagatggaactggaggccataatcctaaacaaattaccgcaggagcaaaaaaccagctaattgcatacacatggacacaaatagggaaaaatagacactggggcctattgagggtggagggtgggaggacagtgatgattgaaaaagcacctatcgggtattatgctgatgatttttcctctgctgtctttccgttattgatttctaatttgattccattgtagtcagagaaaagtttgtataatttaaattcctttaaaattatctgtacaccaaacccttgtgacacgcaatttacccatgtaacaaacctgcatatgtaccccttgcacctagtaaaaccggaaaagaaaaacaacaaaaaagagccaatgtgtattctgctattgatgggtggagtgtcctgtaaatgtggatttgatcctgttggttgatggtgttattgagctcttctacatctttgctgattttctttctagtttttatttttttatttttattttttttgagacagagtcttgctctgtcccccaggctgctggagtgcagtggcaggatctcagctcactgaaagctccgtccccaggttcacgccattctcctgcctcagcctcccgagtatctgggactacaggcgcccgccaccacgcccagctaattttttgtatttttagtagagtcggggtttcaccgtgttagccaggatggtctcgatctcctgacctcgtgatccaccccctcggcctcccaaagtgctgggattacaggcctgagccaccactccctgccttctttctagttttattaatagttgtgagagttgtgttgatgtctccaattataattgtggattttctattttttctttcagttccgtcagtttttgcttcacatattttacagctctggtgttttgggcataaacatttctgactgcaatgtcttcttgatagactgacccttctattattataaaacgtccttatctttctctggtaattttttttgttttggctctgaagtttaccttatctgagagtagtacactcactcctgtattcctctaattaaggaaaacatgttgtgtctttttccatccttttacttttaacctgcctatgttgttatatttgtgtggttttattgttgtttttgtttgttttgtgttttttttgagacaaagtctcatcttgtcacctaggctggagtgcagcggcacaatctctgctcacggcaacctctgtcttccagggtcaagcgattctcctgcctcagcctcctgagtagctgggaccacaggtgcacaccaccatgcctggctaatttttgtattttagtagagacggggtttcaccatgtaggccaggctggtctcgaactcctgacctacctcaaattatccacctggcttagcctcccaaagtgctgagagccactgagcctggcctatattgttatatttgaactgggtttttttttgtttttgtttttgttttttgtttgtttgtttttttttgtagagtgctgggtttacaggtgtaagccaccatgcctggcctgaactgggtttcttaattgaggtatttagatcatttgcatttagtgtaattttttttcttaatttttatgtttaattattatgggtacacaaccgttgtatatattagtgaggtacatgtgatgttagttacaggcatacaatgtgcaatgaccaaatcagagtaattggggcatctaccacctcaagaatttatcatttctttgtattaggaataatgtaattattgatatatgtattagcttggggtgccataacaaaataaaactaggtggcttaaacaacagaaatatattctctcacagttctggaggttggaagtctgagatcaaggcgccagcatggtcagcttctggtaagggctcttcctggcttatagagagagttgccatcttctgggggcagagtgagagagaaagagagaggaaggctgggagggagaaagagcaagagagcataccctggtttctcttcctattgaattaatcctattgaatcatggccctacccttatgaattcatttaacctgaattacttctgtaaaaggccctatctccaaatatagtcccattggtggttagggcttcaacatgggattctgtgggacacaatccaacctgtagtaacatgaagggcttaattgtttttcatttattttgtttgttctctccagttttcatctctgtttactcttttctgactttctgtggcttacttgggcattttttagaacgccagttttatttatctacagtgtttttgagtgtattgatgcataacttttaagtggttgctttaagtattacatatacatgtaacttgtcacagtctgctggagtcatcatttaccattttgagtaaataataaaaatcttaccttcctaatttatgtcccatccctttatcctcctcactgaaaatacgattgtcttaaatgtttcctctacatacatttagaaccacatcagtgttataattttggcttcaaccatcaaacatactttagaaaacttaagaggagaagaaaaatttattgtatttacccatctatttgcttaccttgttctatcttcttccttgatgttccaaggttcctattttatcatttccattctgtttagataacttcttttagccattttcattatttctgggcaggtgttctccccccgcccccatctccattgacatcttagagagggggccccattactggcttgcagaaatgaaattcttagcttcctaattggtcttcttggataccactgcagagtgatgttggagcaccttgttacagcttcaagagggtgaaagtttaggtctcccacttggtctttctggtgtgaatggcagtagagtcacagttattgctatggtatttgcctagaactgaacagttactttctaaggcttgacaggcttgcctgcctctgtcttggtcttttggctagtgatatcagggcttttgttgtaagtgttgttggggctttttctgtttgtttgtttgtttgtgccagttggtctttccaaattgtcactttcttcagctccaagcccagcatatatgtggcaaaaagaaagcccagggaactcactagtatgtcattcctcagatcctgagattctagctgttctgccttctcatttccaccttttagagtcttcttatgtttgttttatatatatataatgtccagagtttttagttgtacttagtgagatgaataggaaaaagtatgtctactcaatttttccagaagtctttgctgtcaacctttactaaattagtaggtttccttttattcctggttttctaaaagtttattttttaaacataaatggttttttacatttaaaaaatagtttatcagaattgactcatttcattgtattttccttcttaatctcctaatatagtgaattatattgagagatttttaaaatgtgaaacatctttgcattcctgggataaacgctatttgttcatcctatagttacacatttactgttggtgttatttagttaatattttacttgggttgttgtatttacttttataaagcatggacgtaaaacttgcctttcttgtatttccttgtttgtttttgtaataaaaatttctctaaacaataacctaggcagattttgttcttcattctgtttcctggaataataaatagaaatgtcttttcaaagggcagcttttgtttttgttcatctattttattgtttttatctctctttttcttttatgactatctttactatttccttcctcctttgggtgtattctgttcctctttacctagcgtttgagttgaacactcagcttattgattttggtctttttttgtgtttcctagtaagtgtatttaaaggtaaaaaatttccttctaagttctgctttaatcatatctaacacattttgatatgcagtgttttaatttttatttaattctacatattctttatatttttcttttaactcacaggttacttgtgacatttaaaaactttttattttgaagtaattttagaagagtagtacaaagaattcttacgtacacttgtccaaattcaatgatttgcaacattttgtcatatttgctttctttttctctctgtctctgcttccctctctgtttttttcctaaaaaacattaatattcctaagtccatttagggacttactctaaatggttatgaaaaaacattagagagaaaaaatggtttactctaaaatggttaggaagtctggagttacatacacacatgcccctttcctgctaaatatttcaatgtatttcctaagaacaaggctgttctcttacataaacacagaaaaacagtcatattaagaaaatttaacttggatataatattagctaatccacagtacatattcaaattttaccagttttcccaataaagaaccttataactccagccactcccagtctcttgtcctgcaatccagaatcaagcatttcagtaagttttcatgtctctttggtcatttttaatgtgagagagtctatcagtttcttatttattcaggttttattaattagcttgaacttatataattttattattttgcccttcaagaactctgctttttttttttttttctttttggtctagtttatctaccagtttttgagagagggtttgtaaaaatcatcaaatgtatttttaaaaaactcaacttctaactgtagttctttcacttgttgctttataaattgtgaggctgtattgttgagtttatatatatttatgattactatatcttcttgtttctttaaaagttatatgaacatcttttcttttgtcctttatgcactttattttttttatttttatttttttttgagatggagtttcgttcttattgcccaggctggagtgcagtggcacagtcttggctcactgcaacctccatctcccaggttcaagcgattcttctgcctcagcctcccgagtagctgggattacaggtgcgtgccaccatgaccggctaatctttttgtatttttagtagagatggcgtttcaccatgttagccaggctgatctcgaactcctgacctcaggtaatccgtcctcctcagcctcccgaaatgctgggattacaggcatgaaccactgcacctggcccaaaatagaatttaaggttaaaaataaagtgcaggctggacgtcgtggctcacgcttgtaatcttagcactttgggaggctgaggcaggtggatcacctgaggtcaggagttcaagaccagcctaaccaacatgatgaaaccccaactctactaaaaatacaaaagtagccgagcatggtggcacatgcctgtaatcccagctactcgggaggctgagtagggagaatcggttgaatccaggaggcagaggctgcagtgtaccgggatcgcaccattgcactccagcctgggcaacaagagtgaaactctgtctcaaaaataaataaataaataaataaataaataaataaataaagtgcataggccgggcacggtagctcatgcctgtaatcctagcactttgggaggctgaggcgggtatatcacctgaggtcagaagttcaagaccagcctggctagcatggtgaaaccctgtttctactaaaaatacaaaaaattagctgggcatggtggcacacctgtaatcccagctactcgggaggctgagacaggcgaatcacttgaacccaggaggcagaggttgcagtgagccgagattgtgccattgcactccagcctgggagacagaggaagactctgtccccctcccaaaaaaaaatcaattctattttgttacatattgagactgttgcccaactttcttttgtgtcatatttgccaccaggtaaatcttttttccctgtttttaaatttcaatctttacatatctttctgctttaagaggatttgccatatgcattcatattaaaaactttcaataaactaggtattgaaggaatatacctcaaaaataataagagccatatatgacaaacccacagccaacatcttgctgaatgagcaaaaggtggaagcattccccttaaaaaccagcacaagacaaggatgccctctctcaccactcctactcaacatagcgttggaagtcctggctggggcaattgggcaaaagaaacaaataaagacgtccaaataggaagagagaaagataaactatccctgtttgtagatgacatgatcctatatctagaaaaccccattgtctcagcccaaaagcttcttaagctgataaacaacttcagcaaaatatcagaatacaaaatgaatgtgcaaaaattactagtattcctatacaccaaacaacagtcaagctgagagccaaatcaggaatgaactcccgttcacaattgtcacaaaaaaaataaaatacctaggaatatagctaactggggaggtgaaagatatctacaaggagaactacaaaccaccgttcaaagaaatcagagatgacacaaacaaatggaaaaacatctcatgctcatggataagaggaatcaatatcattaaaatggccatactgcccaaaacaatttatagattcaatactcttcttattaaactaccattgagatacttcacagagctagaaaaactattattattattattatttttttgagacggagtttttgctcttgttgcccaggctagtgtgcaatggtgcgatctcggcttaccacaacctctgtctcccaggttcaagcgattctcctgcctcagtctcccgagtagctgggatattacaggcatgcgccaccatgcccagctaattttgtatttttagtagagacatggtttcgccatgttggccaggctggtctcaaactcctggcctcaagtgattccccctgcctcggcctcccaaagtggtgggattacaggcctgaggcaccgtgcccggccagagctagaaaaactatttaaaaatgcatgtgaaacaaaaaagggccagaatagccaaggcaatctgaagcaaaaagaacaacgttagcagtatcacactacccaacttcaaactatacagggctatagtaaccaaaacaacatggcactggtacaagaacagacacatagaccaatggaacagaataaagaacacagaaataaaactacacctatgactgtctgatcttcaacaaatctgacaaaaacaagcaatggggaaagtattttctattcaataaatggtgctgggaaaactgggtagccatatgcagaagattgaaactgcatcccttccttacaccatccaccttaactcaagatggattaaagacttaaatataaaactcaaaattataaaaatcctggaagacaacctaggcaataccattcaggatatactggcaaagatttcatgacaaagatgccaaaaacaattgcaacaaaagcaaaactgaccaacaggatctagttaaactaaagagcttctgcactaaaaaggaaactatcaacagagtggacagacaacctacagaatgggagaaaattttgcaaactatgcatccaacaaaggtataatatccagcatctataaggaccttaaataaatttacaagaaaaaaaaaccattaaaaagtgggcaaaggacatgaacacttttcagaagaagacatacatgcagccaacacgtatatgaaaaaaagctcaacatcactgatcattagagaaatgaaagtcaaaaccacaatgagataccatctcacatcagtcagaatggctactattacaaagtcaaaaaataacagatgctggctaggttatggagaaaaatgaacgtttttacaccgttggtgggagtgtaaattagttcaaccattgtggaagacagtgtggcaattcctcaaagacccaaagacagaaataccatttgacccagcaatcccattactgggaacatacacaaaggaatataaatcattctattataaagacacatgaacacatatgttcactgtagcactattcacaatatcaaagacttggaatcaacctaaatgcccactaatgatagactggataaagaaaacgtgatacacatacaccatggaatactatgcagatataaataagaatgagatcatgtcctctgcagggacatggatggagctggaggccattatccttggcaaaataatgtaggaagagaaaatcaaatgccagatgttttgacttataagtgggaggtaaattgtgaaaacacatggacacacagaggggaactgcacacatgggcctattggagggtggaggtgggaggagggagaggttcaggaaaaataactaatgtatactaggcttaatacctgggtaatgaaataatctgtacaacaaacctccctgacacaagtttacctatgaaacaaacctgcacatttacccctgaacttaaaagttaaaaaagagtatttgttataaatcacacatgatttggttccctttttcctccattattagagcctttgttcttttattggtaactgctgaagtaaagatttacttttgcaactcatttcacattctgtttttattgtacaatgtttcttcccttttcttgctttccatttgatagactgatttttttctgctgtattaaaagttatacatactgattctgttcttatggtggttgcctttaatttaacacagtgagcatttaccttttaaaatgtcttaactaccttaatatttatatcttgcctcctaagttctttagcatactcttatgttcttttgattttctacttccctccctctaatgccaattctcctaccaagtagatattacacacacacacattcatttaccctcttttaaaaatatggtcctggatttgttgacaaatcacccttatatttgttgttgtaaatttcttgatttgattctctttttgtgtacttcctctaagagtgtttttttttttttttttttccacgtccaagagtgttttaaatatgagcctttggattctttgcatgataataaatttgttatgccatctcacttgaatagcaattttgatacatataaagttctaaactccagtttattttccttcactactataaaaatattattttattttattcttgcattcattgctgttgaaaagtctgacatcaatctgatcttactcctttgtaaactgttcttttttttttttttttttctgatagggtatcactctgtcacccactggaacctccacctcccgggtttgcctcagcctcccgagtagctgggactacaggcacacgccaccaggcggggctaatttttgtatttttagtagacacagggtttcaccatattggccaggctggtctcgaactcctgtccgcaagtgatccacccgcctctacctcccaaagtcccaaagtgctgggattataggcgtgagccactgtgcccagttgataaactcttctttctaagttttaaaaatatttatttgtctcaatataacgagcataggtgtggatttttctgaagctcctgttaagtatcctttgaacccttttctctgaggtctttcataattaaaaaaaaattgtaaatttattagtcattattttctcacgtatatatttttttcctctcactgtgagttctcttatgattcagatgttgatacttctatttctagcatacattttgctgaactttcttttatatttttgatgtctttattctttcctactgtcttctgggattatctttcatcttatcttttacctcacaaattattcttcagctatatttatcctggtacttgtctaatctatagtatttacaacttctactgttatagttttaacatctaatattctgtctttgtttttgtgagttactggttttgctttatgttgctggtatcttctattatcttaagtatatttgccattttgtttcaagttcttggttcatcttcttcacaattctgcattagatagtatatggtgttaatttgttgtctatgttttgcaatttttttgttccttagccatatcattatgttgatctgtgagctcacgtctccaggagggcaccagctagtctgtggggtaatgtgtaatggggaagagataaagtcaaatactggtctgtgtccctccagatccagccctggtagagagcccagaaacactgtggatctccccatttgccactactctttcaggcaactcctaggaaaagcacagttgggagtaggcaggtgctccacgttgggattcaccagcgctgggagttggggcagtggtcgtgagtagtggagaagagaatacccaaaagctcacccctagtttcatctgttccctactgatttaccttgaagatacaagtagcctggcctgttgcagcctgtttatgtatgaaggggaggcaacaattgtcccaagccgattgggaaggacatagtgcagaaattaaaaagtcttcctgcagcctgttctcccactgtggcttatctcccaggatgcagccctgcccattctctacgcacaccagctcaagacagcagttctgtctctcctggcaaatataaaaacactttatacttatttctggtgttgccagctccccagatccttgcttccttttgcttctctacctttacaaaaattaattttgggtgagggagctggaagcctgaacctacctatttgccatttcacaggaactggaagctttatttctggtcctcaaagggcaaagtgacaagcgacattcaatagctcatggcctgaggcttcctgatgcccagggtcttacactcgtagccaggactgatgtgttgtcatagccattccaagggtctcttttcaaggtgtccaatggggtggcaagcagggattctgattcatctatgctccagggacaggagagaaaggaacttggagattcatgaggtaggcatgaagcttggatagtgggaggggaggaagatagatgtgtgttgagcatttattgtgcactctattgagcccttgctgggtacaccttgagggctaatttacttcacagaatccaggaggaatgccttcaggggtactttcaggaaagtatccatagatttttaggaggctgtgtggtgaagctatgttcatactactagataatatttaccttataggcttcatgatgtataaatctgcctttcctctaatttataatagaagcatccatatgatttatgaattctttcagattagctcttttaggccatcctagctaaatactgagggtgtttagtatcctcagggtgctttgctgcagctgtccccagctggtctcgttttttcctattttctaattggtctctacccccattcctccctcagtctgtcttgacagatggcagatgcatcttcctatgtggcagtgcttggcactaggtttgcagcaaatgcttgttggattgattttctttagatttgaaggttaaaaagagagtttttctctttataggcacccatcccaatttcttctccttgcaatgctcagtagttgctaccaggaagggctgtcaccaggttgtgtcctaactggaatgagctcttgagtgggagtaagcaatgtttgttggtaggtcaaagggttaacaacagttttaagctcttttttcccatgggaagatgaactccagtttaccttatacttactgtttctttgaaatgtactgtttggataaatgtgaaatgtcagctgtattttaaaaaatcacatttatttatttatttatttatttataagtgtggaaatgacccctggttggtgaactacatctatgctgggcagactgcgggcaggcatttagacttggtggacctatatgaccagacccgtatgaaaacctgttgggaaatgtaggccctggactctgttatggtgtgtttcttgaatccgaatatgcctgttttcttggaatcctcactcatgggttggtataagatgtggttcctgtcatgtgagagattcttccatcctagaatggctcccccgtgcctctcccctactcctgtggtcttgtctactatgaccatgcatattcccatgagatgagagggttaagaatcagcatctagaatacataaagactcctgatgaagatgtctaatgctgtcaggctgacaagctatgtttccatatccaatattcctctacaaagctaaataaataagttgccgtataacagcccaccaagtcttttgagtgtgtatgttaatctgaacccaaggcacaactaatttgtatgaagtaagcattgtaggattttttttcctacaaaaataactttctcttcattgctgaaattctgttgtaaataaacaagtggtaagcagaggatcataaaatgttccttgctcaaagccttaaaattcccaaaactccagcattcaaatttctctggacagaattggaaccaaaatgaagtcacagttaataataaaacattacatttgtgtaatgctttgaatattctaaagattttattctacttttcctgtcttctcttctctgactgactcaatatggcttctcttgtacctgcaaaaagatgacttcaaaatccatttctccaattttgaacccactacagtacttgatatccatgtatgccactatttagaagcaaaggaaataaaatcattgaaatgacactttgaaatagacttggtaggacctgaaaactcactgaatccaatcttctcactcagacagttgagtggacagtggtttaatccactgaaagaggaaatacaagggaaggacatgtttgagaggtgtttagagaatgattgataaaaggtcttagaagaggtgagtgtccactatttttgcactggagtatctacccctgctccaaggtccctcatgttcacatctgttggggatgatgggagggccagaagacagcccacctcatggaaataagagtagccaggctacatggagtaggtcgggaagcaaggaggctcaggaccaaggaaaggtttatcgaataaatattatgaaatgctcagctggtatatgaagagcagtgagggttgggggtatcaggatcacaatccatattcagttccaagatgtctggaccatttcacagttgggatatggtcttcctctaaggaagaacatgggctgtttttttcatacttctgatcacagttggcaagaaggaatggttggagtaatagactagtagttgggttcttagatttgtttcttaatcaaattctcatggctaatggcaagatagaatatgcttatacaggacatttatctgaaagttgtgttacagacaacatccattagaatcatccagggtacttcatgaaaatgcagatttctgaataacctctagaactgctgaattaggatccctgggctggagcctgagaatttgcatttaagcctacttcttagcaattcttatgtacactaaaatttaagaagcatatgtaagctggttaattatgaattattcttatcaatgaaaaattataccaaatgagaattaaatgggacaactggatatttcattgctttgaagaagctggtgacaacttcatctaagacttcccagttgctctttcagtattacttctaaatttactattgcagtttatttttcattaaatcttccttctactggtacaaagaaaaatatctttgtcttcccttttaattttatttatttattttgtttgagacagagcctcactctgtttcccaggctggagtgcagtggtgtgatctcggctcactgcaacctccacctcctgggttcaagcgattctcctgcctcagcctctcgagtagctgggactacaggcgcctgccactatgcctggctaatttttgtatttttagtagagacggggtttcaccatattggccaggctggtcccaaactcctgaccttgtgatctgccagcctcggtctcccaaagtgctgggattacaggcgtgagccactgcgcccggccaattttattttttaattaaacatttctgagacattttggctttaatgaaaatgtttccaaagcatgttcaaagcgtagtccttagtttgatggtctgaagaatggaatcatttattagtggagttcaataaatatttattcgcatttatacatacaaggtcctttggacagagtaagagacacaagacaccaccactccctgaaagagcacacaaaacaattacatagataagaccaacacacacatttgaactgtggtattgaaacttaaaaaaaaaaaaagcctaaagccctctcagtaaaaaagagttgagtacttatcgacacttacatgtttatttatacattatcccatgtactagcatatggcttgactatatacaccagaactcacactgtaacaaatagaaagtttataagttaccaaaataaatagaaactttaacacttccttcctgtatcctcaaggatcatttgcacattccctgtagtgtgcacattccattttgtaaaccagtgtttttagaaaacaatgcctacctatatataaccaagcactaagttctgtgttacagattaaaaaaaccattttagagtaaagagaaataagagcaaacccagactactagaactggtaaatgaaaggaatagcattcagaaaacaatgtatattcaataaatagataaaataataggaaacatttgctttgggttcatgtcaaagcctattaagaaggagacatagacataggacaaaatgcatatgtagaggaaaaagaaacaaaatatagaaatgtaaacattacttccttctggcaaaatgtcttctagcctttggtgaggtatttccagacatttataggctacactctgccaatgattttatttaaggatgacacagtgaatgcttatttttatgtctacaaaaaaagttacaaaatttagttattcacacattcattcatcagtgcctcttgatattggaatgtttctccctattgctttatggattgactgtattcctgaaaagcttgaattatattttaaaaactcagccataagctttgtgggagacagactgtacctgtcaagttccctcttgtatctctggcacctcgcatagcatcaggctcatagtgaatattcaagaatgtcctctcgatggttgcaatatatttgaaaatctcagcattgaaaggaattctgtgacaaaccacttaaaaaagttaaaatgaatgaacattcagtaaattctgattttgatgaaacacagttgttcataagtggacaaaactatcctttaagtaaacccatggggacatttgagttgaataatttatagagacttataatctgaaagagagcgcagacatagtctcatattcttttaccacacagataaggaaaagctggagctcacagaaacttgaaagagcttgcccaaggccacatcactatttaggagcagttattttaatatgtaacaaattacgtgtgattaatctttttcagaaggggttactgcaggttttcttaaagtaacagtattagataatattttataaaacttaaaaactctataacataatgcttcataatgtttaagaattcataaacatttagtaaaaatattaaaaacatgcatagcaatgataaaactgacttcacattggtggttatatctgggggcagtgaaaagaaaatggaaggattcagaggtatcaattttattgtagtcactgatttattaaaaaaaccattgaaacaaataggacaaaatactaagatttaataaagctgggtgtttgggtaatgggggtttatttgcctttctgtgtgtttaaaatacttaacaatacaaatattaaaactaaaattagtaagagatttgtaaactaataggttttttaaaataccaagcagaggaacaaagtcaactgttatttatccaaagaaccattaacagaaataggctatatatatatatatatatatatatatatatatatgctaaagggtttagtcaacaaagtagatattctataattagcagcatgaaggagttagagtacatcttatgttgttataattaatagtaaatatttgtaacatacagaaaatacatggaacaacagtcatgcaaccactactcaaatacagttgtgctgtttgcacctgacttcaggtccacctttcttttccctcaccagatgcaattactagtttaaagttagtgcatatcatttgttattatgttgtgagaattgtccttgtgaaatatggacatttagtttattttaatggttgcacaatttattgtagaaaggcaacacaattttatttacttttttatgcactgatgggcatcccctgactttccaccaattataagcaaacctgcaatgaacatccttatgcatacttctttgtttttgtatttgagaatgtcttcaggtctctagggcatataaacatagaattgcttgtctgtaggattcttgtctctttaaatttgtacaacactgcatatgtgaaataagtagttgaaataagtgggaaaactaacccttccaccaagattctatgcaaattcccatttcttcacatttctgcttcagcacgtggtattgttaggctatctaccttgagataataaagttattctacatttcccccccaaagctttaaacctttaccttttcacatttagccttttatttcatttaaaatttatttttgtaatggtgtgaggtagagatctggtttcatttattccccatggtgatagcctatgttcctgcaatattaactgacttatccaacagttctcaaaatgtgatcagaggattcctggggatgttggaagggagagatcccttggatccttttagagggtcaacaaggtcaaaaatattcataaaattaagatgttatttgccttttttttactctcactctcataagtgtacagaagggttcgccaaagacaacaatggcatgtgatgaatagtgatgactatttctctgatacctaacagattgtgtgcctgtgtattgtattttctagagttttcaaaggtagtgagtttacggtataagtatgtagttttcagaaattatttcttttctaccatgctcttaccagctatcttcagttatacctgttataatctctgtaatctcattatcttccaagaaatcatttttaaatcctaaagtttttccttttacacagaaacataacaaaaattatgtttactttgttgttttgcaataatatatttttcaaaaatgtttttaattaaaaaattttatctgaatagggtggatggttggctttaaaaagggagaagagaaaacacattttctggtgtctagattgcctatgtctagagatgctgaaaaggatgacattgacatatcagcaagttatctgattcctcataaaaaggagaaatctattccaaagaaactgagcacaactatacacaacaaaaatatgttgaaagtgatcttttgttcagctttatagatgttaataatttatcatattgtgtcttgtgcagtaaaacattttcaaacacttatatggttccaacaaagttgcagtatcattttgggaccaatcattcagaatttattaaaaaaaggaattaaataaccgaaatgtagatgtaatacactctttaaaagcttcttacaggataagccatcatattgtattggctagaggagcacacacaatcacagagagactaataaaggcttgaacagttgacattgctgaatacctgctggatgaaaaatcaccacaagaatgcatagtgctggcattttccaatgatgcaataacttgtcaaattaaagatttaactgcaaacataaagactgagttaatatatcatctaaagaattgtaccttagccttacaaagggactgatctacagatggctatacatcctgttttgctttcattcatcaggtatcagcatcaattgaccattgatgatcttcttttatgtgaattctgggcaacaggggttctgaaacattaaaagtgttatatgacttttttgaatctggtggtttatcctcaacaactgtgttaactgtgttaacatttgcactgatggtgcaaaaatggtggattttatccaatggtgggtaaaatgactggtgtcttagcacgaattaaggcaatggcaccaaattttattagtagtcattgtattcttcaccaccacacattcgtagtaaaaaaaaaaacagttttactaaaataatgtccttgatgaagttgtaaaaattattttctactaaatctcaacccttaagcacatttaaaaaaattctttgtgacacaatgtgatgtacccataaaacacttctactgcatgctgaaatatagttgtcttttggaaaaacacttgtttgagttgcaagctgaattagccactttttcttttctttcatggaaacaccatcttttcacttggaaaaaaaaagtgacagaaaattgattattcagacttgggaatttggcagacattttcttgaaaataaacagtgatactatcactttagggaaaacaactagttgtatttgttgccagtgctaaaatttaagcttttaaaagtagaagttggaattttgaaaagcttgtatctgctactgtgggatacttagaattttttctgatatcagcagcaacattaatgaatataatatttttttgagacagggtcttgctctgttgttaaggctggattgcagtggcatgaacagggctcactgaatgcagctctcaaccttatgggctcaagtgatcctcctgcctcagctttccaagtagctgagaccacagatgtgcactccactcttggcaaatttaaaaaaattttgtagagatggggtcttgccatgttgcccaggctggtcttgaactcctgggctcagacagtactcctgccttggtctcccaatgtgctgggattacaggcataagccactgcagccagtttgagtttttgatattgcatgaaatgtttgaacatttcgaatacctccataattcagtaaacagatatttcctaatgaccatataatgttacagaatcttacatgagtaaaaataatttcaaaatgcggataggccaatagatttcaatgacttcctgttgtttatcccctgaaccagaagatttacactcaccctagattcttacctttccctcaaccccttcattctattactcagtactcagtgtaaattccacctcccagacagcagacagctcttaagtgtatgctttcctgttcattactatttctaatgccctcattcagaactctggcaacttactttatgatgtcaaatctcttacgtagcataagaggccactgcccacctctcttctctagcttcccccatttcactgtattgtctagtaagctgatcttattatagcttttttttttttttttagacagagtctctctgtcgctcaggctggagtgcagtggtgtgatctctgctcactgtaatctccacctcccaccttgagcactcctctcgcctcagcctcccaggtagccgggaccacaggcgcacaccactgaacagggataattttttttgtttttgtagagacagtgttttgccatgttgcccaggctggtctcgaactcctgggctcaagtgatccacctgcttcagcctcccaaagtgctgggattacagccactgtgcccagcctattatagctctttataaaacaaaaacaacaaaaaaaccgaacatattgattcatgactccctacctttgcattcacatgattcctttgcctggaatgtcccccttcttctacctgcttgggaattcctagctatatctactaaaattctattcagatgtctttttccaggaagcttttcttaacctaactcacgccattaagttattcgctttatttttctaggttatcttctatttgtttctactgttgtactcatcattctgtaaggtattggggctctgtagaatttctgttacaaaattactttttggtttgataatatttacctacattgagcaatcccataagaaacaggcctgtgaaactctctattgggtttcctaaaacaatattgttgagagattatttaattacctagctttctttttatagggacttgccagagaaatatatttctggtcttatcatattagttactcttcagatttgttttagaaaatagtcaccattaacaccttttagaattggttggtggaaagtttccaatcaaaatcgtggtccacctctagcaagctgtaaaattttatgatctccaattagcctcagtttaaactctagtcaggcatttagcttcacaaaaactgaagtcagggatagtcagttttcccatattagtagagagctgggaagtgctgatgtgcacaacctgcagcctgaaatagttgctttttctaaataacagtaaaactgttgctctctgaggatggataggtggatgctatttgttgtttgcaaagcttagggaaccctgtggttgagattttttccaatacatgcattttttttccctttgcaaagggactttggataattgttaattttcccaagaatataattataattcttttattgtttaaatagagttaatagtttatctacagtttcactttctgcagtttcagttatccatggcttgaaaatattaagatattttgagagaaagaggaagaaaaagaggtgtcagtcacataacttttattacagcacatcgttacgtttctatttcattattagttattgttcatatcttactctgcctaacttataaactttaacatgcatatgtatgggaaaaaaaacatagtatatataaggtttggtactatctgcagtttcaggcatccactaaggatatcagaacatattctctgcatatttaggagcaattaccgtatgatatttttttctttctgtgtaaacacatggtgtcatagtccattttgtgctactgtaacagaatatcacagactaataacaaataacagaaatttattggcttatagttctgtaggctgagaagtccaaaatcaagatgctggcatctgggaagggcttttttgttgcatcatcacacagaggaaggtggaagggtgacagagagagcaagaaggggctgaacttacccttttataacatcaccaatcccaccctaatcacctcttaaatattccacctattaatactgttatcatggcaattacatttcaacatgagttttgcaggggagaaacattcaaatcatagcacatgggttaggtgagaaatgaagagtgaggtatacaagagcatccagaaccatactatatacattccagctgttttggtgtagaagcagcacaaatgtagaaactgcattgtttcttgataaaagggtcctggaaagatgaccagctatacagtttccactagaggaaatgcagattggcttgtacgactttagagtatgaaatataaagatctggagtctgttccatgttttttcaggactggtgtgactatattatggataacgaaggaaaggagcctcctttgaaagaagcatctaaattagggatgggctcctcatttggaggatgttagaaactacgaatcaatgtctctcatgttcaatggagctcccatttttatcggtttcatgagactattattaatttatttgaatccaagatgagtctcaaatatacccagaagaaaaaaaattaagaaatgaaaccaagactcctaatgctttgaatgttcgtaacattcgagaaaaatttgagcctgggctatataatcaaagtctaggatttgtgaacctaacagggttccactgtcacctgttttcaagagagtgctgagaaaaattccaatctataccttaaacaattaggttaaatgatttaaagaaattagccttcagaggactgaatttttaatgatttttctacttggaaaatgtgacttctaaataaaaaaagtgcttgcttattataaaaccttggttcaaaggtaaatactatgttctgacaagtgtaaaataagtacaagcacatgtgaaaataactgttaacagcaaatgcttaagaagtgttcttgttttctaaaataaacatttcctgttcctaaagtttttggatcagaaaatggaaaaatataactctagttaatggggatatgcaatttgactgtagaccaataattaattgtcataaagactttaaaaatccttctagattaataatgtgtagaggagtcttagaggattactcagtaaaataaattcaaggtaacaatattaatctaagtttctttaatattcttgatctgggtaaacattttcataaattaattttgtgaattttgagtttaaaatatgtcctgctctaatttcaccatgtgtaaaataaaaaggcaatcatagtattttagtccatataaaaccatgcctccatttataaaaacagactttttttggacagtttaacagttacagaaaaactgaacaggaattacagagagttcccgtatgtcccctcaagccctcttccctccagtttccactattagtaacatcttgcattagtgtggtacatttgttaaaattggtgagccaatattgatacattattaagtccatagtttacattagggttcactctttgtgcagttttattggttgttatattttattggttttgacaaaggtatgacatgtatccaccattacagtatcattcagaatagtttcactgccttaaaaatcctctgtgctccacctattcatccaacccttcccatggaccactggtaaccactaccttttcactgtctccatggttttgccttttccagattaccatatagttggactcatacaatatgtaatcctttcagattggcttttccttagcaatatgcatttaaggttcctccattatccagagatggttttagttgtcacaacttgggtagagagatcaggggtcaatgctactggcatctagtgggtggtagagactgaggtagctcatgagcatcctacaatgcccaggacagccccctacaaaaaagaattattcagccccaaatgccaaccatgctcgaggttgagtaaccttgtgttaagagtgacatgtggcatgagaaatggggcggttttggctcatgttgtgatattctagattcaggtatttccctgagcagagaggctgaaatgctgaaaatttttcatttgatgaccttgatgcttcctttcctgaccatcgtaaagaacaaatggctcctttgctttggcaagaaatactgaaggtggtggcttttttctgtttgttttgaaatgaagtcttgctatgttgctcaagccagtcttgaattcctgaacttctggtctcaagtgatcctcctgactcagcctccagagtagctgggactacaggcacatgttactgcaccagccttcaacgtgattttttttatttcattcaggtgacaaactcatgctgaggttcccaatttttgtctcagagctaggatattctaaatttgtaaaaaaaaaaaaaaaaaaaaaaaagttaagaaatattaactttctatgaaacactctaaatactaacaaagagcttggtgagttctcccacttacctgtgtcccatctgtgcttcagttgcaaatatatatatatatacacagagagagagagagagtcttattctgtcacccaggctccagcgatcctccctccttggcctcccaaagcactgggattatagggatgagccactgcccccagctcagttgcttattttgcattatttcaaggcagtggaggcaaaacgctcaaaattaatttctcacagatcaacatcacatcttggagtaaaacaaacacatattgaaggtattttaatgtatgttttcttgaacttcttctaactaataggggaaatattttcattaacttttaccaaagatttctggatagtgtaaatatatttttctatttgggtaacagtttatagtatgctgttatttctctgttcatttatttatttttatcatatacctcctagagtaagatttaattgatggaatgttttgtggattctgctgtaattaatgcacataatagcagtcagtaatagatttctgtaaacctatatttattaattatctaataccttctccttcattttgctgttgatttccactaagtagattaaattgtgttcttaaaaacagaaattcatttgtgtatggatacaaaacagaatgttcccaaatgcaatcttggatgtgatgctctaaactttagaaatccagcttcatttattttggattaatttctcccgcttggaggctgacacactgttttacatctatcaaatgcatgattataaaattaacaattttgtacaataatgaaattaaacacacacacacatgaactgtaaactatacagcaccatctctgtgtcatagttttaaaaggcacttccagatgacataaaaaatgaagagatattttttaagaacctattgatttttgatctccaattttgtgtgtggggggttgtttttctttaaccctagttttatctaatttgagattcatgaacaaggtatctctaagggaaagagcagcaggtataattattagttattttataagactttgtgaagtctttggtatagttctaaaaacaaagtgaaagaacctaatgtatgtataaaaatagttttgcaagtcaattggtttctaattctttgctttcaacaaaattgaagaagaaccttatacttgagttgtcagctgacagattattaaaaatattatttaataatagcccattatgtgagttttgcatacgactaagaagaaattttaaaaattgggtgaagttgcctcaacaagtctttattttctcattcatttatatcccagattcattaacaataagtaacatttgtcaacatgaaattgggaaaataaagtccctatccatctcattaagagatgcatttctagttaaattttaccattacaaacttacacttttatttaccaaaatgtgtattacagattgagcatccctcatcagaaaatctgaaatgctccaaaatctgaaactttttgagcaccaatatgatgccacatgtaagtactgtacttaacacaacttcgtttcacatataaaattattttaaatatggtataaaattaccttcaggctatgtgcataatgtatataagaaacataagtgaacttcatgcttagacttgggtcccggcctcaagatatctcattatgtatatacaaatattttaaaatccaagataatctgaaatccaacacacttttggtcccaagcatttcaaataaggcatatccaatctgtactgacattattttgatctctaacagttggtaatcctatcttaatccatataacttttttttgagacagcatcttactctgtcatccagggtagagtgcatgcagtggcacgatcatggctcactgcagcctcgacctcctgggctcaagtgatcctcctacctcagcctcccaagtagctgagactacaggcaggagccaccatgtccagtaattttttttttttttttttttttgtagagatgaggtttccctatgtgcctaggctggtcttgaactcctgggctcaagtaatcctcctgcttcagcctcacaaagtgctgggagtacaggtgtgggccactgcacccagcccatataacttttacacttacaacaagaaattaaaaattcaatgtaagaacatattttgttgcaaagaagcagaataggtggctcaataaaagatttccaagaacaaagaaaaaaattacattaggatgtaaccagggttgagaactcaaaaaaaaaaaaaaaaaagaaaaagaaaaattctacatggggggtagaataaaaatatgaattcaaagtgggaaaaaagagcaatgtaaaatttccaaccattaagaaagaggttgtttgtatattttttaaattaatgataatgggtgtcaaaacattatgatatttagattgaattgaacatatgagcgattaacagttttattttaaagtgttaatatggagaatatgttggaaattatatattttttgcaactatctggacacatgttgacaattttaggtctgtctaagtctatgggaggaggcatatgacatttcacaatccttgtaggagagatgtgaagggaagacccctgagctattcttcctccttcttgtgttaccccagtaggaaaatggacttataactggagaagagaagctaggtgtcagcagagacatgatggagtggacatttctttcagtcctttaccaggaagtcctctcaaactgaggaggaacatactaagggagagacacactagtcttgaagcccatggcattcctgaagatccacctcacaccccaaattaccaaaccccaaagctctcttcagctcagtaggttgtcctttaattttcagtaacccttccctacagcagaagaaccaatttttcttttccctcataatttgaatccctcccactaatttatttgaagatgaagatattatcctcttttactaccagtgaaaatacaatgacttgagaagagaaaatgatctgtgtgacgccagggtagaagtggaagttgtgggccctcgaataaaccactagtcttatacttgaagcaggataaacaataaatgccaaacccaaggcagaaactagaaacatggaggaaaagaggcataaatgcctcatattagacagttacattctaagaaatctttcttgcagcagttactttcctacaatgaccaacttcctctgactccaaatttactccttatgtacacttgggttagatattcctttgactatccaatcataccattgtatagtaccatttacacatgcatacatgctcacctaaagaactttttgtgtgtgtgtgtgtgtggtttttttttttaaatcgagtctgggacctggtttcgctccattgagtcactggtgaaaaatttagtaaatctacgaagagagtttagtaagtgtaagaagagtctgctcactgtgtgtgatattccaatagattcatgtgttctacacacagggatctcttggatataagggaggcatttctcaggtgtctgggtgactttctggtcattatccaggttcctggctcagcttcccaggtctctttgaataagcagaggggatccacattcagacaaggctcctggggctctgaccagaggggctggacatccctggtagacctgacattgggcactgagactcctggaaaacttaagctgttaattttgcagttctccatcttgactgcttctcggactgaccatcagttggtgggttttcatcagccttctgcctcacctcctctgatccaagcagcagcagggactcacttgcatgcactggtcttgtaggcagtgacttttaagccacatcctctgtctaccaggctaaacttgcctgcctgagaggcatactccttccatcctctatcgtacatctgtgagctaccaactctggccctagtgtgatactgccagaatgttgtgtacctcatctatttagagtgggaagcccataaggcaaactgaagaggccccgtatcctcactccctttctgctcagttttttcatttatattatctcaacttcactctactaaccagagcaccaaggaagggtaggttagcaattacgtctatgatgactatagagaagtggggagatgacttatgatcctctttgtgctggattccctactgaaggcatctgatggcttctgatttccctggtctgagaagaaagtccctctccacctctccctccttactctacctcaggctgaggggctcaggcaaccttttatgttgcatatggcataggtatctctgcctcactccagaagggaccaaccaatagccacctactcacctacttctgaggtctagtgcctacagacctggtgttcataaatttaagttctggatttaggtctcctttcctgtagccaggtgatcagtgaccggcaaaaatcaagatcccagacttcctgagtaacctcatcaagactgaggtaacagctcacatagctagtgcatagacagatgcaggttacatggagtctgaatcccgtacacatttggaggctccctttgggactgctgggatgcatgaaacatgggatttcactcacagttgtgctcactatgtgtgatattcctatagattcatgtctctacacacagggatttttgatcattctgaattgttgattcccataaaaaatgaatacatggtgatcactgtatatgctgcattactgaatacatatttacgagagtctccaacacatctttacacgtctgaggagtaaaagaatttcccacagattagcttctggttcccatttcaaacctcatttctgttccacctctggcattgggtgtagtatggctccttagtgctccaggccaaaataagtggcacaggggtaaagtcatttctggtggggggtgggggatttggagaaaaaaagaaaggattgcaggggagtacactgggagggttaggagaaattctggagatacggtccactcaatggaggcacatacaaccaagctgagaaacgacatagtacccaacagagttgggagatgtgaaacccaaacatcaatctccacctgggcatagaggaaatactcgatttccaagcaggttctaggttcagaggagagagcccttggttggaagcgccggtcttgcaggatggggtgggggcgttaatgcaaacttctggtccagcagaggtagaaacagaccagatctaagtagcagctcagaggcagcggacttgagggatgaagacgtgaggcccagagggtggtgcctggcagagaaaacagctgccagacaccaaggccacctcgggttaaagggaacaagttatatccaaaaaaaacccaacacggtgaaaataggaagaataaggatatcacctggagtgttctcctgagacactccccaagaacctggattctttaacaatccctccagagcagggacactcagcacatacatctcccacaaagtaaagtgtctgaaggcctgggcaaacccttctccctccccttctctctcctccacgggccggcccggaggaggctcagggatgagaactactgtcactgctgttccccacctcaccccaacgagagaggaatctttagaggtctgtatccctccttcaccaccccgcctgagcgcctgctggaaaacacaatcaccgtctcaaatctcaccctgcaactgcatccaagcgctttctccaagcgttcggggagccgccggaactcttcttccagacaggcgttccgagactccgcacaataggcacctacccttggggttttgagccgcagtgtctgcctctgttcaagtatccaggctcaggtacagacctttcagtgcaggcggcgggaggcgcgaacacggaggaccccctcaggcatactgccgcccgggcggcgcctgacagattgcctccttgggatcggcggacatgccctgggcgctccagctccgcgcgcctcagacacaggctatgattggcctggctgaacgtcaatcagggctcggcgccgtggaggcgggaggaacgctgtaggcagaggccgcttaactccctacggggttattctccgcctcttctagggtaggcaggtgttcccgagtcccttagggggggtccccgcggcggcctgagatgctcggcgccaggttgtcgcgcccttgagctggctgaagtagacattgactctggagagtctgcgtttttcctggtcccagagccgtggtcccgatactgcgcttcccgctcctccagtcccagctcccaggctccgtcttctcccgcttggcgctggagaaacaccggaagagagagtcgcagagtgactgctgtggccctgcgacctgactgccaccttccaggactctagccctggctccttctaaccttcccgcccctcagtgccccagagaggctggtttgcggacaattattcatcagccggaagaaaaggaggtgccagtgttaggcgcagaagagggttggaccagaaaagctggagaggggcaagaggggaaagagggggaagggggaaggcggaaggcggaagaagtcgggaggggtaacagctcgagcttttcctctagcgtagtttctcttctctcggtgccgccccatctgcttcttgcctcagttccccactcgcacccgtgcacctctgcggcaggcgtgtgaaaggaatgggagggggggcttttggtcgggatatctggtcctccagaccccacagccttggctgagaacttacttaagcccactccaactgacttgataaatgagaatcttgaccagcccactggtaggtagaaatgagggacgtcatctatccctgaatggaataacgcgaaaccgcaggtcacgtggatgtgggaatccacagcactggctgcgctcctaaggctcctaagtccacttccgaacctcatctaagaccctgaaagccagactagggacacattggattattattattattttttttatttgagacagggtctcgctctgtcgcccaggctggagtgcagtggtgtgatcttgtctcactgcaacctccgcctcccgcgttcaagcgattttcgtgcctcagcctcccgaggagctggatctacaggtgcgcaccaccacgcctggataatttctgtatttttagtagagacggggtttcaccatgtttgccaggcttgtctcgaactgttgacctcaagttatcctcccgcctccacctcttaaagtgctgggattacaggcctgagcctctgcgccagtcctacacgttggatcttttcccagacctcctcctcagacgtggagcgtacaaatgatgctccatcggttactctgatcctgactttgggactgccagataaaactgggagaaaccctacatttactcttactgtaacgtattggcttgaaactgcaggtcagaacccatttatgttgagaccaaaagactttttttccaagtagaatgaaatagaataaaatacaattgaaaatacttgcctgcatcacaggtaatgagagtaactatagtttcatgaaaccgttgtttcagttaaatatgtttttgcgtgtgtgcatgtgtatcgggaggagatatgtatttcatatatatatgtagagaggtggaaatcaacaacaaaactccataatttttcttgttttctaacagttcttgattttgagtaaaaataattctttaagaacaaaattttgagccagctaacgaaagatcagagtcaagcagcctctcattggggcctgaatagaggttcatcttatttggctttttcgtttttttcctatcttgtggactccttttaaggcccagcaaggaattaccctccccaagtttccactctctgcttggttcagccattcagctgtctctcgggctctttgattaataaaaagtccagtagagctattttatcctatgcatgtgtgggaagagggcaatgccagtgattctttcctgatttgacagaaaattcacaaatcacgttaccttctgaagatagagattttaagctcaaacattatcaccagagaactgaattattaagaaagatgagtggtcaaaagtacagatgttttacagattaagggtcattttgtcaggtcctgtccaaaatatttgaagtctaggggtttgaaaaattgttagaaataaccatttatgacaacagttttcatttattgttctctccagcttcaggagcaggggagaacatttttttccttcttaccttgctgagaattttttcaccagggtttcaaggctaagaactgaaattccagcattgacattgaattaaaaagaagcaagcccttttaggaagtcaaattttattatatgagatggaatgtaatattgagattacttattacttaggcatgggataggggggcttttaacaacagaccaaaaaaaaagttggaaggataggaatgaaataaagcaaactttcattattcatagatgatacaattgtctacagagaaaaataatctaaaacataagaattaagagtttggcacagtggttggctaaatatataaacaaatctattgcattttctataaaaacaaaaaagtagaaatgtgattaactggtttatataacaaacttacagtacagttgacctttgaacaacatgggcttgaactgtgcaggtctacttatatatgattttcttctgcctttgccacccttgagacagcgagaccaacctctcctccccttcctccttcttagcatattcaccatgaagacatgaggatgaagacctttatgatgctccacttccacttaatgaatagtaaatatattttctcttctttatgattttttaaataacattttctttgcttttctgagacaaggtcttgctctgttgcccaggctagagtgcagtgttatcatggctcactgtagcttcaacctcctgggctcaagcgattctccacctcagcctcccaagtagctgggactacaggtgcacgccaccctacctggctaaatttttaattttttgtagagatggggtctcgctatgttgctgaggctggtctccaactccttgtctcaagcacttctgcctcagcctcccaaactgctggaattacagccatgggccaccgcacctggccaacattttcttttctctagcttactttactgtaagagtacagtatataacacataaaaatataaaatatatgttaaataactttatgttattggtaagacttctgatcaacagtaggctattagtaaagttttggaggagtcaaaaattatgtgcagatttttgactgcacaggtggtcagcgctactaaccctcgcattgttgaagggtccactgtaatcaggaataaattctcaaaaaggaaaggcatgcaagatcttagtggggaaaattaaaatcattaaaagaagttgaagaagtactgcacagatggagagacacattcatggttaggaagcatcaatatcattaaaatgccagttttccccaatgtgatctatagtttcatgctatttctagaaaaatttcaacaaaatgttttatagaattggacacaatgatattaaaatgaaacgaaggaacacaagttcaagaagagccaaaataccattgaaaataaagaggaagttggggaatttcctgactacatgagaagatattatatacaccactggatttaagaccatgtgctattattggtgagagagggagtagacaactgggccaatagaatagaatggaaagagtgtcaggaccccttgtatgtgaagaatggtcattaaagaccagtgggtaaaggatgtataattcaataagtttgaatttatgacactggattagtggatatatatacatcataataaattccagatgaactaagtaccgacgtattgaaggcaaaactgtaaaacttttaaatgaaaatgtgaaagaaatatttgtatgacttcaaggtagaaaaatatttattaaaaagacacacatacacattttaaaaacaaaaatgttaagagaagatgaataaatttgaccacattaaaattagaaactttaatcaaaacacactctaaaggaaaaaaagccacaatctaaacttatttatatcacacataatttacataggatcaatatccagaacatctaagaatagccccataggaaaatgatcaaaagatgtgaaagggcagttcacaaaaagggatatataaaagaccaataaacgtacaaaagttaagctcacaatagttatcagagaattgtgaattagaacagtccttgaaataacattttaaaatcactaaatagacaaacattgaaaagtctaacattatcaaaaatcaatgaggatgtagggtgaggggaactcatactctgatggtggacttcaaactgaaataatctacttggaaaaaaattggcattttgtagagttgaagctgagaatatcctaaagcatagcagctctacccttaaatatatatgcaccttagggaaattattgaataaggcaccaagagcaatgtgcaggaaaagtcatgagagcattctttgtaattgcaaaaagctggaaacaacccagtgtccatttgcaggtaaactgatacacaaattttggcataatcataatgtggaattctctgcaacatcaagatcagtggaatacagataaaataataaacttgcataattcttaaaatcatattgttgaatgaagaaaacaacagaaaactacattttgatattaattatgatgttaatttgttgtcagacaaagacaatatttactatgatgaaaagcaagataatgatcaactccaaatttggaataatagttgcattttgcagagaggaagggagattctaagggaagacaaatacaggaaactttaatgttaagggtaacgttccattccttcatgtgactggtgggaaaaaatggatgtttaaaattcttgtagatatgcatcacatgcattacttatttgtagaaaaatatttcaaaaactggatcataagaaaaaaggaaaaagatgtataagaaatcatttgcatagagacagaagtaacaaaggcaatttgatgaaatttattgagacagaagactaaaaaatgaaaaaacatggtaaatataaaaatatgatggcagaagtaatccagatatatatgcatttgtaatgtccatttatatcattgcattaaatctaaatttttctgctcagtaaagatggtctgtgtgtgtgtgtgtgtatttgctattcaaaaagtgctggtggcaatggcttatacctgtaatcccagcactttgggaggccaaggagggaggatcacttgagcccaggagtttgagatcagcctgggtaacatagcgagaccctatctctacaaaaataaaaaaattagccaggcgtggttgtgcatgcctgtagtcccagctactgaggaaactgaggtgcaaggatcgcttgagcctggaaggttgaggttgcagtgagccgtagtcgcacccctgcactccagcctgagcggcagactgagaccctgtctcaaaataaaaacaaaaacaaacaaaaagcacctaaaacaaaatgacaccgagtgattaaaccaatggacaatgataaactcaggcaaatgctaacaaaaattaattatggatagaaatactgtcttactccattttgtgctgctataatagaatatccaagactggataatttttaaagaacagagattgacttattacagtcctagaggctaggaaatccaaggttgagaggcctgcatcttgcaaaaatcttctggctgcctcatactgtggtggaaggcaaaagggataaaaagagagctgagagagagaaagagaaagagagagcgcccaagtgcaacaggttgaattcacaggcttttagcctttttgtaattggcattaattcatttatgaggatggagtcgtcatgacctaaacacctctcatcattaagcctcacctactaacactgttgcattgaatattacatttccaacatatgctttttggggacacattcaaaccattacaaatactaatattgaacaaagtagaataaatgatgaagaaatttttcagtgtcaaagaaggatactttattatgctaaaatgtacaattcaccaactacccataagttataagccttcatatcctaaacaagtctttgaaagttagggaaaaaaatgtgctttgttaggaaggataaattgacacatttaagagcttttagcatacttttaaactaaactgtcatatccaattgtaaaataatgtgaatgtaagatattttgctaaagcaaataatgatcttaagttatcaaatatttataaaattgtgtactcaacaaatagtgaatgcatattttcccaaacataatgcattaaaccacaaagtaaaattaaatagaaattagaaactacacgggctatattctctcaccggtataaaacacatacatagaaaaacaaaacaaaactaaaataaaacaaaacaaaacctcaccaaaacagtactaacaagaaagcctccacttggaaacttaaaaacatctcactaatttttgggttgaaaaggaaatcaaaattgcaattcaaaggagttatgtttttgctaggaatatggagggaattcagttcagaattcatttctctatatagtacagcaaagagaatgaaaaagaaaaccacacaagaacctcatttttagtgaaactaggaaacaaaaagtatggttacatcccaaattgcatgtcatttgtgcttaaagcaacggagagcagaactgggcataagaagccaaaatgttgctgtggcaacagatgaaagcgtggagggaactagtggtgcgggatctcggaaagggcccgaaaatattctctctctaagagtagaagccagcctaggttggagctgttggcagttggcctgagctacagtgaggcccagatgctggggaaggcagaagaaggcccacatattgggggagcagactttgttttggaggttccaaggtggcagataacaaaggttccctctggaatgcagggggtcctaacaccgtggtagaatccttcctgaaatagattaaattccccaagttggaaaaaacatggatgcagcgtattttaagataaagtttacgtgttagtaataaaggattggtccttcggttgtaaaacctgggaggttactattgcccatgtcttctctcaccaacccatcatcccacccccatccaataggagtcttccactaatatctggtccaggaatgctcaatttattcagaataagtaggaaaagaaatggcacagttccacataaatatgccatgagaaaaaaatgtttacagaaagcagcaagatttccctccagaagtaatgaagcaacctcagccatgaagatcatggagccaaaaggatgaccttcagcagaagcagttacgagccaaagaggtccaagggcactgagggaggagccaagtggtaagggccacctctggctgggatccagggtgcccaagtgggaaaatgagcaagccagagagtgcttggtctagggattaagaaaagcacacagtaataggttggacactaaatttgaaaatgaacagtgagaaaaatgctgtggggaccaggattgaaatgaagtaacagaacaattaaaattacatgatccagggacagagacttgaactcataaacaggcctgtgttgcccattagtcacaaggggagcagtgagccattgttaaaatgccaaggattcccaatgcagtttacttggaactttgcccagcgatgaaggagtctgacttgtcttttctgtaatagttagaatcaaagaaaaataaagcacagctggtgggagggtgagaagcaagcatcatgaaccacggtctaattcaaggatcaaactgctgtccagttctggcagattttggattgcaaggggaataaagctgagaggccatattggcacctaggcacagtgaggtgagtctggccacgcatttaagaagcccctgcaaaatgatacaggtggttactaaaaaccacctctggcctctggaaaaaaagaaatagcatctcccggataagaatatctgggtctcacacctattgaccaggtcgagatagggttcagttggggatgggatataataaaaggcatgggtaaagaaactgggcagaggcatagtgcctgcatgttggagattaaggagggaattcggaactcatttttctatatatattacaacaaaggttaagtttggaggttaagtaaggatgctgcagctcactcatggttgcttttccttcagagtactcatgcctcggcttacccagggggactcaaggagaggaatgtgtgtgcgcatatctatctatctatctatctatctatctatctatctatctatctatccatccaccttctaatctacctaaatcaatcactgtgtgtatctattccaaccacaatggactcctatcattcaatttcatttagtggtacatctcagcccagtttacagaaaagctgtaaagggctgtaaaaggctgtatgagaacataatctgaaaagcgttgctcaaaagagcatattatatattattgggcatttatgaagaaattagatctcacactgagctagttaataaagatttataattacaaatgggctgcagcatgtgattctgaacttgactatttccttttgcccttcagtttcagactatgatatggattatgattctctaccaccccctagtggaaattcattcatttctttttaagtcctgtttcttctaatcatttagtctaaatgattagactaaatgagaaaattacatagtaaatatctggattcactcttgttataaaaggttcaaaccggccgggtgcggtggctcacacctgtaatcccagcactttgggaggccaaggcgggcggatcacaaggtcaggagattgagaccatcctggttaacacagtgaaacccccgtctctactaaaaacacaaaaaattagccttgcgtggtggcgggcgcctgtagtcccagctactcgggaggctgaggcaggagaatggcgtgaacccaggaggcggagcttgcagtcagccaagattgtgccactgcactccagcctgggctacagagcaagactccgtctataaaaaaaaaacaacaagttcaaaccatacagaagggtacggagtaaaaggtctcctttgtttctccctcctccccattccattctaggtcccaaaggtaactgtgtgtagtttgtgttatactaggatatttcctgtgcttttacacattccaggtatatggcaggaaaaatcctgagacatcaactgaggattattttcctcaggcatctttctacaacagaggcagataacgcatttcccctcatgccatgggagacagaccacagcaaaacagcaatgaccaaaagattaagatttttcatttaaaattttacatttgaaaaccatggtaggccaggtgtgatggtcacatgcctttaaccatttaggaggctaaggcaggaagattgcttgagcccaggagttcaagaccagcccggacaacatgacgagactcagtttctacaaaaaaaaaaaaaaaaaaaaaaaaagaaaagtaaagaaaaaaaaattagctgggcatggtggcgctcacttgtggtttcagctactcaggaggctgaagcaggaggattgcttgggcacaggaggttagggatacagcaagccatgttcaggtcactgtactccagcctgggtgacagagtgagaccttgtctcaataaataaataaataaataaataaaatagaaaacccagtagaggccaaatgaaagaaaggtctttggagatgaaaaaccttagattactagatatctgaagtcagcacttgttccataaataatagatttgggaagtactccggataatcttagagccaattttcttctgtggaagtgataagaatccacaggctgaagacagaaagagtgtcaggaactggttttggggtcttgcactctgtaatccagttaaactgtgtgacagagggtcagtgcctcctccaactcagatattttgggcatacaaggatgggatcaaagagtgtgctgtttctggtctacggaatattacaaatttgaatgaaataaaaatatttctgacagtttctaaactctcttttcttagtactcaatagaatggactgtcatccatgctgggtaaggaaagatcttgacaaggaaaggaaggaatcagggtttcatgagagacagggttctagggatccaagcaccatgatgaggtaatggctaagttttctcttgggtaatgcaaagaaaagttgacctttactgctgtgaagcaaattagaagctaacccggggtgcattcgtttggtttcttccagaagcatccctgacacagggacatgaatgaaagtaatttattttggaggtgcatgaaacttcagtagcagctgagtaaaagattgggaagggaaaacagccaacgaagggtgaatgactggaacttaatcccctggggaaattctgggaaagcacttgcctcagagttaacccagccacggaaggagggagttgggcaattgtacatcaattcccattggttgaaggctgctgcctgacacgtgaactcttcggcccttctagtctgctgtgagtcgggcagagtggcccttcttggctttgaggaagccttcaggaatgatgcaaatgtccagccagtgtgcactacagtggtaaggcccaaggaacatggcaggtattagtagcatcagccataccaggtctatttctagttggagaacccttagatgactggagcctgtgatctcttacatctgtaatatctgtgatcagaatggaagaattttctattgtcttttccttttcaattttgcccaagccttcataaagttttgttaaaactttgacaacagtcttatttttacattcctttaatcaagaaggacaggcctatgtccaaatataggaggatgtattagtttgctagggctaccataagaaataccacagactgaatggcttaaacaacataaacttattgccgcctggctctggagtctagaaatgtgagatcaaggtgtcagcagggttggtttcttccgaggtctctgtccttggctggcagatggttgtcttttccctgcatcttcctatggactgccccctgtgtatgtatgtcctaatctctttttatatggatactagctatattaggacctactttcataacctcattttcacttaattatctttttaaagactctaactccaaaaaaaattcacgttctgaggtactgggtttattcaacattatgaacttatagggggacacagttcagcccaaaaagaggaaaatggggcaaagggaaaatccttcttctccatcttctttcctgttctctctcaaaggccaaggtgagtgagagcaacattggatcatgggatcttggttgccctgcaactcaagagatatttggcttcaacgttagcagtgagcaacagcagagctgagaacagtggtatagaactgagtcacactgagtcaggctacatttcccaggctaatttgcaaaccagaattccagatataatttttattcactcaaactttccactcatgaacttcttaaatgtattttgaaaaactatgcacatcctcatacatgttttttaaatttaactttttattttgaggtaattagagagtgacatgcagttgtaagaaataatacagacagaaccttttaccctttaatccagtttccctgatggtaacatcttataacacttcagtacagtattgcaatcaggatattgacatttgtgtcaatgtcaatattacagtcaagacagtatttttgtcactccaagtatcccttatcttgcccttttatggtcggttcacctccttcccacccccatcacttccttaaccactggcaactatgaattttttctctatttctgtacttttgtcatttcaagcttcttaatacaaaatgttatacaaatggattgtgctttttttttcttttcaataaagtttattttatttatttatttattttttttgagatagagtctcactctgtcacccaggctggagtgcagtggcaccatctcagctcactgcaacctccacctccaaggttcgagtgatgttcatgagtcagcctcccgagtagctgggattacaagcatgtgccgtcttgcttagctaatttttgtatttttagtagagacgggtttcaccatgttggccagctggtctcgaactcctgacctcaatgatctgcctgcctcggcctcccaaagtgctgggattacaggcgtgagccaccacgcccagcctggattatgcttttgatgtcaagcctacgaattctttgcctggccctacatctcaaagattttctcctatttttctaaaattttaatagttttacacttcacatttactctgtaatccatcttttttgtttctttatctatttttagagatggggtcttgctctgttgctcaggctggagtgaagtgacgtgatcacagctcactgcagtatgtaaccttttgggactggcatttttcactcagtataactctctggagattcatccaggttgttgtgtgtatcagtcattcttttttattgctgagtattatttcatggtataagtgtacaatagttggtttaaccatttacctgttaaaggatatctgggttatctttggctacaatgagtaggcagttagacaaacatttgcatacaaggttttgtgtgaaggcattgtctgtgcttgtgtatttgtgtatgcaagttttcatttcttggggctaaatacccaggagtacagttgctgggcaggatggtagtagtatgcttagttgttggatttttgttgttgttgttggttttgttttgtttttaagaaactgccaaatcatcttccagagtggctgtaccattttatattcccatcagaaattatgagagatccagtatctcttcttccttgccagcatttagcattgtcgccttttttttttttttttgagaaagagtttcactcttgttgcccaggctaggtacaatggtgcgatctctgctcaccgcaacctctgtctcccgggttcaagtgattctcctgcctcagtctcccgagtagctgggactacaagcatgtgccaccacacctggctacttttgtattttcagtagagacagggtttcttcatgttggccaggctggtctcaaactcccgacctcaggtcatctgcccaccttggcctcacaaagtgctgggattacaggtgtgagccaccgcacccagcccattgtcactatttttattttagccatcctgataggtgtggagcgattatctcattgtggttttaatttgcatttccctaatggctaatgatgttgaacaacttttcatgtgctaatttgccatttttatatcctccttagtgaaatattaccttaagtcttttgcctgttttctaattggatttttaatgtgttttctttgttgagttttgagagttctttatatactctagatactagtcctttgttcaatgcatagtttgcaaatattttctcctactgtgtagctcattttttcatccacttaccagatcttcacaaagcaacagttttacattttgatgaaatccaatttatcagtttttcctttcatagatcatgctctcaatgtcaagcctaagaattcttcgcctagacctatatctcaaatattttctatttttctaaaatttaagagttttatgctttacatttactccataatccattttgtttatttattttaattaattgtatctggtaaaggttaaggtattgcatttctctgacatttttttttttttttgaaacagagtcttgctcagtcacccaggctagagtacagtggtgtgtcacagcttatgacagcctcgaactcctgggctcaagcaatccttctgcctcagcatcccaagtagctgggactacaggcaggagccaccacaccaacattatttttcatttttgtgtatagacagggtcttgctatcttacccaggctggtcttgaactcctggactcaagcaatccaatccagttggaattaaattttgcataaggcgtgagacttaggtcaagtttcatttttattttattatcttgcctatggatgcccaattgttccatttcaccattgttcaattcactatttgtgaaaaaggctatttttcttccactgacttccttttgcacctctttcaaaaatcatttgggcagattgtgtgggtctttttctacgttctctattttgttccactgatttgtgtgtccattcctctgctagtaacacacagtcttgattactgtagctataaaacaatacttgaaatagggcagactgattttcaactcactttattcttctttttcaagaatgttttaggcgtcggcgtcgctcccgccctggagctctaggcccgcttttccccgcttgagtctggcgtcggggtcattgtgtcttgacaaccgctccggtacccctttccgaggcagcaggtgcggccgctttagccttgagcgggctccgcgtctgcctgctggtctctgctagtgccgacccttctgttcgcggaccccacgccaagcagcgaccctgagccgacaggcggagcacccggcaatggcggcctccacggcctcgcaacggcccctcaaggggatcctgaaggacaacacctctacgacttcctctatggtggcgtcggccgaacatccccgtgggagtgtccacgagcagctgagcaaaaaatcccagaagtgggatgaaatgaacatcctggcgacatatcgtccagcagacaaagactatggtttaatgaaaatagatgaaccaagcactccttaccatagtacgatgggtgatgatgaagatgcatgtagtgatacagaaaccactgaagctatggcaacagatagcttgctaagaacttagctgctgctgaaggcttggagccaaagtatcaggttcaggaacaagaaagcagtggagaggaggatagtgacctctcacctgaagaacgagaaaaaaagcgacaatttgaaatgagaaggacgcttcactacaatgaaggactcaatatcaaactagctagacaattaatttcaaaagacctacacgatgatgacaaagttgaagaaatgttagagactgcacatggagaaagcatgaatacggaagaatcaaatcaaggatctactgcaagtgaccaacagcaaaataaatcacgaagttcatagaagggatttgttcaacactcttattgtttgttagatatgaaccccgttgctataatacattgcttctcgttctccacaagtcatgacttaagtaccaaagtgcataccagttattatatattgccaagaattaaatgaaaaccttaaagactgattagactgaaaatgcctaattgatatatatattcttgtgcctagtactttaccacaaatacggtgtaatatcatcagtccaaaactgtattacttttgtaaaaatactggttaatttgtatattatatagcttttcatgctttagaggttaaacaatatctttggggggggggaactaatttattttcatcactctaaatgtggtgatagctcttataaagtttgttgacttttttttttaaccaaaagccaattgaacaacaggatatatatgctgataaatattcaggctgaatagtattttaacacttgtcttcaacttgatttgtctgtttaattgaaaaggattgtgacctggcacggtggctcacgcctgtaatcccagcactttgggaggccgaggcaggtggatcacgaggtcaggagatcgagaccatcctgactaccacggtgaaaccccgtctctactaaaaaaaatacaaaaaactagccaggcatggtggcgggcgcctgtagttccagctactcgggaggctgaggagggagaatggcgtgaacccgggaggcggagcttgcagtgagccgagattgtgccactgcactccagcctgggcgacagagcgagactccgtctcaaaaaaaaaaaaaaaaaaaaaaaaaaaaaaaaaaaaaaagaaaaggattgtaagagttactgttacattttctggcctactacctttaaaattcctgttgcatttctttgtatttacaaggaaaagactgaactttttctcatcaaaactagcttttttctcacaggttaaacttgcaccaatgtctgctctttttttttaatgtttttggtactctgggcagacttcagttttttaaaaaataaagattctaatgcagctatcttggcattccctttaaatacctgtcttaacctcctacttttatttcctactcctttccacacacatgcatacaatcctttaccttttaaagaatcattaagactgtcacacattaggaactctttcgctcactcttctgtcatttgctgcaatattgaaattcttattttgaccatcaatgcctattaattcttctaatacatgaagaaaatgattgagtagcagcagtactataggtgggaaatacagtttaactgctgaatttttatacctctctgatttatagcttgctaattaaattgctattaatagtttgtttggcttaattagacttaagaaaacaacaggttttttttttttgaggtttttttttttttttttgcatgaggagagaattgtatgtaaccagtgatatgattattcctgaatgtacagacagaagtaagcctggacattgtttaatttaaaaactttagtccctgctttaagggaatatgataatgtatactatgacaaatgtactttattcttctaacacagtaagaattacttggaactttttcctgaaactaagtgcaggaaagccctgtgtgtcttggtttagtgatggtttcatttctagccatacaactgatggattgtatacaatttttgttagtgccaaaataatctgttatatgaacagacttctaaaataatttctgtatattatatatgtaagaaggcttttattgaacagcttattttccacttgcaagtttatggaaatatcaatatgtcaaaataaaaagtgggacaattctttgctgttagaagaatgtgcttattattttgatttcttaaatggtacataatcaaagtactgctgaactataggtgcagtattctactaaacatttcagctagtaataccactgatttagaaacaaaactgtttatttttgctttctgaatttagaatgctgggattacctgtttaaatatgttttagggaatatagagattaaatctgtacatacctgtgcacatatattcatgcaccctctgattttggttttctcgtttttgagttcttagaaagtatccacatactcttcttttagtagaagtagctgttttagagagaagaaaaggatgagactttaaatagttgattctttttgtgttttctacaaacttttttgaattttaaatcacaagcaaactaattttctggtttttagaaagtagatgatgatttcagaggagtaagacatgccaaacagcgtgctcggtaggattttaggtagtcaaatgcagctgagaaaaagtattttcaagtcataagttgctaattgatatgctatgaactagtcaaaataggaaccatatgattcatgttagattttcctctagagatggatctgaatgttcagttccagccaaggtagattttactttcaactttttaatcaatatcactttctgtgcttaatctctttggtgttaccttgtccattttcatttgtctaaaattctgcagggatgactacaatttggcataatggtataaatgaattgttaagggtaactttaagttgaagattaaagcaagatgccattttccccatgtctttcattttgtttacattttttccctttaagttagtatacactacacatactacaataaaatataataatatgaaaaaagaatattttagatattctagtccctttgcctttccatgtaaattttagagtaatcctacctataattaacaaatcttgcaaagattttgattggaattgtgttaaacttgtatattggtttggggagaattgacatatttactatattgaatcttccaatccatgaacagtatttctctccacatagatagagactgaatagatcttctttgatatcgttcaccagcattacatagtttttagcttgcaagtcttgcatgttttgttagatttacacataagtgtttcatgtatttgagtaattgtaaataatatatttatatttttgggccaggcgcggtggctcacgcctgtaatcccagcactttgggaggccaaggtgggcggatcacaaggtcaggagatcgagaccatcctggctaacacggtgaaaccccgtctctactaaaaatacaaaaaattagccgggcatggtggtaggcgtctgtagtcccagctactccggaggcaggagaatggcgtgaaccccggaggcggagcttgtggtgagccgagatcgtgccactgcactccagcctgggcgacagagtgagactccgtctcaaaaaaaaaaaaaaaaaaagaaaaaaaaaaaatatatatatatgtatcatttgttcattgtgagtatgtagaaatacaattgatactggtttatcctgtattctgttaatttgctgaaatcacatatctagaagtttttctgtagcttccttgtgattttctacatagacaatcatgtcacttacaaatgggagctgtttatttcttacttcacaatctgtatgcctttaatctcctttttcatgcctattgcactgtctagaacttccaacactgtgaataagagtggtgagagtggacattcttgccttgttcctgattttaggtagaaactattcagtctttcagaatcaagtatgttcaccataggatttttgtagacgatctttatcaagtaaagaaagatctcctctactcctatatttctgagattaaaaaaaaataatgaatgggtgttaaagtgggttaaatactttttcttcatcaattgatatgaacaagtaaattttcctcttcagcctataatatgatggattacattaattaattgtgaatatccaaccagctttgcatccctgggataactctcacgtggtcattgtatataattctttttatatgttggtaaattccacttgctaatattttgttaaagattgctgcatcatgaggaatattagtctacagttttcttttcttcccattgtcattgtttggttttggtattgaggtaattctagctttataaaataaactgggaaatgcttcctctgcttctattttctggaagagattaattggtgttaattcttctttaaatctttggtagaattcttcattgaaactatttgttcctaaatatttccttttgtgagtttttaaattatgaattcaatttcctcaataggtgtagacatttttgaattattttatatttagtgagttgtggcactttatattttttgagaaaatgatccatttaatttaagtgtcaaatttatgtgtgtagaattgttcatagtattcttttgttatccttttgatgtctgtagaatctttgatgatatcccatttcatttctgatgttggtagcttctatcttctgtcgtctttttttctgagtcttgctagtggtttgccaattttattaatctttcaaagagccagctctttgcttcattgatttttttttgcttttgtttttctgttttcagtttcattgttctgcttgctttttattttgttattcttttactagattcttgaggtgagagtttagattattggtttgagacttttcctcttttccaatgtatgcagttagtgctttaaatttacttctcaaatgcaaatcaaaaccacaatgaaatgccatctcacgccagtcagaatggtgattattaaaactcaagaaacaacagatgctgacaaggttgtggagaaatagaaatgcttttacattgttgatggaatgtaaattagttcaaccattgtggaagacagtgtggcaattcctcaaagatctagaaccagaaataccatttgacccagcaatcccattactgagtatatacccaaaggaatacaaatcattctattataaagatacatgcacttgtatgttcattgcagtactattcacaatagcaaagacatggaatcaacccaactgcccatcaatgacagactggataaggaaaatgtacatatgcaccatggaatactatacagccataaaaaggaatgagatcctgttatttgcagagacatggatgaagctggaagccattatcctcatcaaactaatgcaggaacagaaaaccaaacaccacatgttctcacttataagtgggagctgaacaatgagaacacaaggacacagggaggggaaaaacacacactggggtctgtctggggcgaggttggagggagggagagcatcaggaaaaatagctaatgcatgcttgtcttaatacctaggtgatgggttgatatgtgcagcaaaccaccatggcacatgtttacctatgtaacaaacctgcacatcctgtacatgtatcctggaacttaaatttacctcttataactactataactgtatcccacaaattctgatatggcatattttcatttttgtttagttgtgtttattgtgtgtatttttaaaaaatttccttgagacttcctccttgacccatgtatttctaagtgtgttgttttgtctccaaatgtttagatattttcctgttgttgatttctggtttggttccattgtggtaggagaacactttctttatgattttatttaaaaaatttgttggtcttttattgtcttagatatggtctatcttggcatatattctgtgggcacttaaaaaaatgttattctggctgggtgcagtggctcatgcctgcaatcccagcactttgggaggctgaggtgggtggatcacctgaggtcaggagtttgagaccagcctgatcaacatggtgaaacctcatctatacaaaaaataaataaataaataaataaataaataaataaataaaaaattagccaggcatggtggtgtgtgcctgtaatctcagctactcaggaggctgaggcaggagaattgcttgaacctgggaggcagaggttgcaatgagccgagattgtgccattgtactccagtgtgggcaataagagtgaaactccatctcaaaaaaaaaaaaaaaaaaagtgtattctgccatggaatactatgcagccataaaaataatgagatcacgtcttttgcagggacatggatggagctggaggccattatccttagcaaactattgcaggtacagaaaaccaaatactgcatgttctcataagtgggggctaaatgatggacacatggacacaaagaggaaaaacacatactggggcctattggagggtggaggttgggaggaggcagagggtcaggaaaaataactaatgggtactagacttaattcctggatgatgaaataatctgtacaacaaacctccatgacactgtttacctatgtaacagacctgcacatgtacccctgaacttaaaataaaaggaaaaaaaagaaaaaagaaaaaggaaaatctcgtggaatctactaaaagcaacgaaaaagaaaataatgtatcttctgttgttgggtggtgtgttctataaatgttgattagatcttatggtttgatgttgtttattcttctatgttttttctcaatttttgtctatttgtttaatcaattgttgagagaaaactattgaagtcttcaactatcattgttgacttgcctattttcttttcagttctatcagtttttgctttacataatttgcagccctgttgtttggtgcatacatatttaagattgctatgtctttttggtagatttacccttttattattacatagtgttcctatccatttctagtaattttctttgttctaagtttatttgatattaatatagcctccctttattattttttgtctgatatatgtttttctatcctttaacttataaaccgcctatatcattatatttgaagtgagtttatcataaacagcaaataattgagtctttttttttttttttttgagacggagtctcgctctgttgcccaggctggagtgcagcggtgtgaagtggtgtgatctcagctcactgcaacctccacctcccgggttcaagagattctcctgcttcagcctcccgagtagctggggctacaggcttgtgccaccacagctggctaatttttgtacctttagtaaagatggagtttcaccatgttagccaggatggtcatctcctgaccttgtgatccacctgccttggcctcccaaagtgttgggattacaggcgtgagccaccgcacctgacagagtcatatttttaaatctattctgccaagctctgtctcttaaaattgatgtatttaggcgatttatatttcctataatattgttatgtccaggcttaagtctgacattttattttctgttttctgtttgttctctctgtttttcatttctttgttttctttttcattgcttcctaaataattttaaaattccattttaatttatctatagctgtgtgtgtgtatgtgtgtgtacctctttggatagctcttttagtggttgttctaggtattacattatatttatgtaacttatttattgtcattaattaccagtctgagtgatgtgtagaaatttcttctctctttgtttaccctccctcatttataattgcctgtaatattttctctatatacatttataaccatatgatacagtattatacgtttttcttcaatcctataatttaaataactcaagagaagaagtaaagtccattttttaacccatattttttcttgccatgttctttcttccttcctgatgttccaactgtcctcaatttaactttttgtttttttagggtagacctgttagtgacaaattctgttagttttccctcatctctgtatgtcttaatttccctggatatttttgctgatatagtgttctaagttgatatttttttttcctttcagcactggaaaaaggtggtgacctccttcgggcttacacagtttctgatgaaaattttgctctgtcatttttttcacctgttagatgtcatttatctcactgctttcaagattctttttatctttaatttttagttaattactatgattttggtgtggctttctttgggtttgtcctatttggggttcactcaccttcttaaatcactaggtttatgtcttctgccaaatttgggaagttttcaaccatatttatttgataatttttttcagcttcactctctttttcctctcattttgggactctgagtacatgaacattaaatcttttgttatagccccatgggtccctgaggctttgtccattttttccagtgtattttctttctttcttttgttcagattaagtgattgctattgctgtgtcttcaaggtagctaattctttcctctgttctctccttctgctgctgagcttatttactgggctttttattttggctattgcacttttcagttctaaaatttccacgttttcttccgtatatatcctatttttatgctgaaacatcctatttttttcttttctgctcttttcttcttctttctttttttaaaccactgaactggacatcctatttttttcattcttttaagtgttaattgctcatcaaagcattttaataatggtggctttaaaatcttcatcaggcttttctttccgttttggcatctattttattgtcttttaaaaattcaatttgagatattcctggttcctgatatgacaaataatttccaattgaaacttggacatttcaggcattatgttataaggctattggtcttatttaaactgttttagctggcttcttttaacacctctccagcaggtaggcaggtgagcttcatgacgccaggtaggggtaggagtccaggcttctcactctgccttcattgacacctcagataggtccccattattactgagtggggacagaaattctggctccctattaggtgcccactaatacctccctggttggttgggagaggagtgccacttactatccctcacatgacctttattgacaccaagatgggacagtggagtggaggagtgagtggtaggtatcagggagtggttgctggattaactctgggtggtgatgaaaatcctgactctccattaggcattgtctgacatcaccctagaggagaggggaagagatgcttcattactgttgggtgaggaatggaagtctaggtttccattgacatttcaggggcttggggaaaggagtacattttcaccaagagggcatgaccatcctgactccctattcactttctctgacaccatcctggtgtgtgtgcatgtgtgtgttgaagtgttgggttccttatgacagcctggtgagggtgaaagtctaggctcctcatttgaccttagctggtgggggtggagtcgcagttttttctgtggtgtttggctggccccattacccaagatggagtgtagtggtgcgatcatagctcactgtaacctcgaactcctgggctcaagtgatcctcctgcctcagccttcagagtatctaggactatgacacatcgaactatgcctgactaattttattattattattcatagagacagggtctcattatgttgcccagggctggtcttgaactcctggcctcaagcgatcctcctgcctggcctccttcccaaaattactttaaatgatataatagctgacagcttgaataggtcctctttattttgttggaggcagagtgttagaagtgacctaacaaaaaggatttgtttcttgtcactagactcattcactgtgtcaatgagtgtgtcagtggtttgtgggaagcaaacttaaatgaaaatgtatatttttaattaaatgttatgagatgctttttttaaactattggctcttgtgaatttcagaaaaatattgcaagtcatttgacttagctacttagcttgcactctatgtaaaaattttagaattttacctctttgaaaaactcctaatatcaatagtgatattgttgttttgcagcctcaaatgattttgttactttggactaattttcactgagctagttaataagtgactttttattgtctaaaaaattcttaagtgtatcatagagagaaagattattgggtcactaagtggctttctatatatatacctttgtccatatttaatttttgcaaaactcaaattaaggtggtaaacttagtgtggatatacattcatgtattgtattgataagattaactacgttttaaaactaaagtggaaagttttaaacaaaattgtcattcaactatatatgtatttctgtaaaacacacacgtaatgatgaattcgaattaataagcaaaaaaggagaggatttgtaatttaaaattgatcttggaatatacactctacacttaagacagagaaaaaactttttctttccctttagcataatctgcccagctagcggtggtttcttatcagaatgctctcacttaataccttgataacttttagtgctttgtgctgatagcatcaagtttttaaattattttaaaaacaaacaacaacaaaaaaccatttgcttctgaaacacctaaagtttcttataattgttaccttctttatgtttattttcaaatgttttattgtcactctggttattgagatatcaaagttataacaattgctcactctcaggtacctatgcacttaagtgaccagtttctctgaaaattcttttttgttgttgccttcttccaacctcataccctgaattcagaatactaacactgtcaagctatttttcacgcccccaaatctttgttttttctcactagacagccactacccatttggccactaggtggcgcaaaaggcttaatttttcaccttcctccgcctactgtgaaggaagctaaaagtaattagatgtgtttggcatgatttttatattttaaattaacgctgtactatcaaaagaactacctgtgtctcaaacccacaatgtggtaaaagctgacaaataaaaaacagtagctcaattttctagattaattttgtccaggttaaaaatattattgatatatgttttagtgaccacataggtttcagtaagggtaaaaggatgctcttgttcgtactccaagtctggcatggtgactgtcaatacattcattttgaagaagattttgcttctgggtttagccctaaaacaggccaaatagagacgataaaatgagtggaactgaattagagcatttctgaaaagttttatttggttaattctgccccttaaggtcagaaattgtgtaggaaaagtgtttcaaaattataaataaggcaaaattgtacgtgcttgattattttatatcacacttgaacctttgctcataattctgcctgatcaaaaccagagtgtttcagggattgtaatttgcctaagacgaacccggccagccctgtgcgattagaggttaatcagcagagagctgataagggatgctggctttctctttttctccggtaaagaagataacaccaaggttatgattttattgccctctagcacgttagccattttgaatctctagcctagaaattatttcctcacagagagatacagctctgtttttcaaatactctttggatcaaggctcttgtattcttgctggttccctctttgagtttgataaaactttgaaaagtctaccaaagaaatttctctcagaactagactttagagaggaaatgctggaactacggatgagaggcacatgtatgtacagggtcagaccacgcagagagcaggtctgatgagccacaccactgctgctgccccatggcttctagacgctgctgttggttctgttgttaggacctggaggttgctgcagccaccactgaagacacctcctaaaccacttctgtttcaggaacttcacttaaaaaaaaaaaaaaaaaaggaaaaaacccaccgcttccccaaaagacagttgcttcttctgtcacctttgccagagaaataaatacagtaaaaggtgctctgcaacccccacaccctggttcctcctgtggcccctttgtaactgaagtcttaggtggatgaatttaattggtggaacttaggtgctctagcttcaaagaaggctaggggaagtgagctttctggtttccactttagggaggcaggactcaaaaggtaggggaaatttcacagtactctaaaggtgttcaaatcccatgggcagccagtaaacatcacaggtgtgaggtgctgggtggagtggctgccgtgaatatgtgttttggttcatggactacatcagtggctcttaaagtccagtaattcacagattcatgagagataataaaatgattatttttgttttaagccattaagtttggagttggtgtgctgcccagcaatagataatggaaacatacagtatgtatttctgcaagtctggcttcttcacttaatattgtttctatgagattcgtccatgttgttacattttcagtagttgatgaagtttcattgtttacatagtactgtgttgcacgaatagactacgttttgtttatccatttactgttgaagaaccattttgttaaacaatttgagagtaatctgtggaaattatgccacttgacccctaaatattttgtcatgtataatttaagaataaggacatttctcctgcaaaaccctaatactgtcatcacccccaagatacttaaaattgataccatattatcaaacacacaatccatattaaaaaatcccctattgtcccagtaacaccttatagtaaatgtctgttattttaagcgggtgtcattcattacatggcaataggtaactaatacggtgagtctgcttcttccagcaaggaccctcagggggtgcggtgattcatagttctcactcagacttctctgtgtctgctcatatgtccctatttcatatctcagggtccggtctatcccaaccaggggtcttgccttatcacaacagctgctgttggatgatgcaacaaacatttctacaacttcataacctttatcataagcccccgggcttgaccctcagccatatctgtgctgggttgcaggagaaaagatagcctttaaaactgctatagaggcatttacagtttttcattcatgtcttgagtttggattaaaggcttttaatttgtctttttttcctttgtatgctcttgagggcagtctgacgcagccagtctctgaaggttggcacaaaagcctccatcgagtcacccagcttttgcctggtacctatcctaacctaaaaccttgccacatgttaccttggcgaaaggccagtgccacacttcagtgatgattcggctgtcctacttggttagaaccgagttcacttccttcctcaacactcctgccacattgatctggaagtttcaccttgagccaagtgatagttaattttatgtgttaacttggctaggctatggtttctagacatttgaataccagtctagatattgcagtgaaggtattttttagatgagatttacatttaaatcaatagattttgggtaaagcagattaccctccataatgtaagtggcccttccaatcagttgaaggtcttaggggcaaagactgaggtcctccaaggaagagggaattctgcctctggaccaccttcagactcaagccgcaacatcagctcttcctgggtctccagcctacctgcagatttcgaccgtgccagctcccacagtagtatgagccaattacttaaaataaatctctctctgccaacatcctattggttctgcttctctggagaatcccgactcatacaagccactttctatagaaggctgtttcttcgagaaatccaccctcttctatgtcaacagagtttagaatctccatactttatctcttcatttttgagaacataaattctgtattacacatacttatactatactatatatgaaactttcataaacattgctgggcaaagttgaatattgctgaaccaatttccgatgcttctgaataagttcaatggagttaaaacatttttcttcttacatggtatgtccagtgccccagagccagcagagttaagaacttggtaaggaagaccaaagataatccatatattctagtttgttatataatataaaacatgtttattagattctaaaagacataaaaagaaaataatacatatgtatcagtgagagaggtgcaaattaggaagagaactaaggattattcttaattcctgccttcctttctaaatcccaatcctcaattgaactctttaattatatttcctgtttattttattgaatggaaaaaatggaaaattatctaacatttgtcatggaaatataggagaaattactctcagagatatgatgttatttaagtcattgacatattgttaacctcagatgcaaatggtggaattaataatattcctcagttcatggtacatagtcactgttggtctagtgctagtttgtagttgtatttgtattttttattttttagaaatacggtcttcctttgtcacccaggctggagtgcagtggtgtgatcacagctcacagtaagctcaaactcctgggctcaagcaatcttcctgccttggcctcccaagtaggtaggactacaggtgcatgccaccatgccagctaattaaaatgttttaaatttatttttggtaaatggggtcttgttatgttgcccatagtttttagtgctatgataagctagtaattatagtgaacattcttgtcttggatacccaaggtttttccgttatgtatactagtggttacagattttttggattataacctttgccaaaataggaaagttttgattcctgcttccttaactgtttttcaaaaatcacaaatggatatactttaccaaatgtcttttattaatagactgagcaaaggaaatgacttttctatgaatatggtaaattatagcaacaatatgttttattatattgaaccaccctagtattccaaggattccctatttgatcttgatgtatcattattagcataatcattattattattgttattattatacatatttttagagacagggccttgctctgttgcacaggccgaaatgcagtggtgcaatcatagcttactgcagcctcaaactcctgggctcaaatgatcttcctgcctcagcctccctagtagctgagactacaggtgctcaccatcacacctggctaattttttaattttttgtagagacaggatctcacaggatctcagtatgttgacaatgctggtcttgaactcctggcctcaggcgatcctcccacctcggcctcccagtattattatttgtaatattgttgaattcggttcataaataattatttttttctcccatctgtgttcaaggtgaaatgggtctattatttttttttccttgagttttccacaactcaatttggagtcaagattacactcggctgataaaattagctaatcaggtttagtttttttctgttttctggaaaaagtatataatatagaagtttcatgttccttgaatgtttgatagaactcatctgtgaaaccatctgggcattttcaaaaatatatttttttattagatgccattgataactttaaaaattgctttaatactcattggtatagtcaagttttgtatttctttttgtgctaattttgatagattaaatgtttctaggaatttgcttatctcacctaggttttcaaatttattagcatatacttgttcataacactctatgctttatatctgtgtcatatctgtagctgttccccctttttcattatgtatttgtttattcattttttctccctttatccataatcggccttgttgtaactctgaatatcttacaaatatttttaagtaagcagcttttggaatcaaaagtatgttaattttcactacctagttttttgttctctatttctgtttcattgctttctattcttatctttataactccttttcttcgtatttctttaggtttgctcaacttctctttttccaaatttttgagtagaatttctaggtcctttattttaacttttcttgttctaataaatgtatttgaaattataatattattttatatgtatattttatgtgtaacatttttaacacctggttctaaaagagttaattttctttataactgctgtttatttatttgacacagggtcccactctattgctgaggctggagtgcagtgacgcaatcatgcctcactgcagcctccatcttctggactccagcgatgctcccatccacgactgccttttaaatccatgttactgataaatatatttgttcacttacaattttaagtatattttagttatcaagttctaattttattacagtatggttgcagaatatagtttctttctttctttttctttttttttttttttttttaagacagtgtcttactctgttgcccaggctggagggcagtggcacaatctcagctcactgcaacctctgcctcctgggttcaagcgatcctcccgtctagccttctgactagttgggattacaggtgcaccccatccagctaaattttttgtagagacggggttttgccatgttgcccaggctggtctcaaactcctgggctctagggatctgcccaccttgacctcccaaaatgttgggattacaggcatgagccactgctcctggcctagaatatagatagtttctaagataccgatactctggaatttattggcgttacctttatggaatgatgcatgtcctatttgagtaaatgttctgtgtggcttgaactattatatataatttttggttttctggcaacttttaaaaaatgaattttatgaatcttgtacctcattttatttccttctttgctttcactatcctatggcctggagccaattattttttatccatttatagttggctgataaatatgtgtcctgttaaaccggctctctgaagaaaaacaatgcttctgacttgtagcattgctgatttctatagtataaatacttccatagtggtcaatatcaagttaccaatagttaacaactgtcttcaaaaatcctgaatactttgcagtctgctcttgctagccagtataagacagcgcaccacttttttttttttttaagatattcacgttgtccattagtttccattagtttcactccttggcttcacttacttttcttaaccatattttctctctgacccagtgttgttttcttcttttaaaaattgttttaaattatctctgtaagctgctacaaaccttttattggaatgaagggcattagaacagttatttggccaatacagaaaaatgaagtcttctaattttttttttttttttttttttgagatggaatttctctcttgtcgtccaggtggagtgcaatggcgcaatcttggctcactgccacctttgcctcccgggttcaagcgattctccctgcctcagcctcccgagtagctgggattacaggcaccatgcccagctaatttttgtattttaagtagagatgaggtttcaccatgttggccagactggtcacgaactcctgacctcaggtgaaccacccgccttggcctcccaaagtgctggaattacaggcacgagccaccgcgcctggccgaagtcttccaattttaaaagatctaatcttcattcagttctcaaagtctttgctgtgcccttaaggcatgtcacacgcatgtgcagctcaggggtaacctggtactcctgagggttcagactcagaattagggaatttccgcctgtactctcagtttggagattcccctacacattcctgcccgcaggggccctttttcttcattcctctggccagaaagccggtatttctcttgttaactcagggcttgtgctaccacgcagtgcagctctgcacctgaggcctgacgtcagggcagagctgggaggaaaaaaggggaaaacattgaaaacccactccccaggaggggcccctctcccagttttgaccctcttcacaatccacctgcttttgtttactttttggagtccttgagtacttgctttttgtatactgcccagaatttctacttgtgatcagtgggaaaaatgggctatttaaaatctcaaataagttaaatatcatggctagaaacaactccaggcatttgtaattttagatttttttctttacactccagggggatgtgattgttttagagttttgaattcgtatgtttagcctgagatcctactagtatttctgttgaatatgcctgttgactgcccacttgttagcaaaatggcattgaatgttggaactgtaaactaccttagaaatcattcagcaccatcttttgacagaaaaggatatgagagttcactcctgtcactcaggaagtgcaaggcaaagatagaagcagaattaaatttgttttaatacagttactcagccatctggtaacagtttcctaagtgccaacgaatgtatggggctatttattgcagattttaagatgatatatggggattgagggaatgagaagttttagggagtggtagaggaagggcatataataagactgaatcccagatcccagcctcagaacttattttgtgaccttggtcaagtgatttaatctttccaaacctctatgtgtcctatagaagtaataataatacctatatagggttgggtgttttttttgtttgttttttctttttcttttcttttttttttcttaagatagggtctttctctgtcacccacgctagagtgcagtggcgcaatcacagctcactgtagcctcaaactcccaggcctaagcgatcctcccactcagcctcccaggcagctgggactacaggcatgcaccaccgcacccgactaatttttaaatttttttgtagagatggggttctcactatgttgcccaggctggtcactaactcctgggctcaagcaatcctcccgccttgacctcccaaagtgctgggattacaggtgtgaatacagggggttttttggtttgaattttaagagataaaatttataaaacatttagccaatgccacaaatgtagcttcttttggttattgtcattattctttgaaattcacaagtgccccaaaatatttaagcatttttcatgtattgccctttaatatgaatgaatgcattatgaaaggaattcttttacatgcgagtttgctgatagtcttagctaattctcatgtgtgtaggtgtcttgcctatctgtcagtcttagccttaaaggaaagagtcccatcacctcacttgcggcctcatcatcatggaccgcatgatgatgcggaatgagaatttttattgtttgtactacttcaaaatcattcagtacgtgatcacctgtcatgtatagggctctttatatttctagtttagtcccttttgttttctctaggaaagatgttttagacctgggacaaaagaagaaagagtgtatgctgacatctaggagggaagcacccacctcccctaagctccatctccctgagcactcatttcccaatgaccataccaggttttggccctagagagtttattacaaaataagaaagagaagtctggggaaggttcactcatcatagaattttggcagttcattgcccaagatgactcgatggtccacaccggcagctgtaatagtgaccaggtagatgacacccccgcttgagccatcccggctcatggccagagcaatagctgcagagggtttcaagttggagagagggagagagaggatggcttagcttcaaaaatctttttactccccctccatccatatgcctactaccactttcacctcaaaactcatcttccaggaaggcatatttagtggtgtgctggtaaatcagtttttttacaaaaaggcttccatatgtggcatctgctgatgtccgtggtgtaaatgctcccgctatgatgaattgcaagttacaaatagctaagcagttcacaaatccttgactatttaacagtccgctctcatgagtggtcccaagccagcctcagcacacctcagcacaccactggttctttttttttttttttttctccagacagggtctctctctgtcacctaggctgcagcgcagtggtgcaatcaccgctcactacagccttgatctccccggctcagatgatctttccacctcagcctcctgagtagctgggactacaggtgtgcaccactatgcccagttcatttttttttttacttttttttattgttttttgtggagacagggtttcaccatcttgcctaggctggcctcaaactcctgggctcaagtaatcctcctgcctcagcctcccaaattgttggcattacaggtgtgagccactgtgcttagcacaccactggttctcacagtgactgtgtatcctcatttgatttactcagaacagccctggtttatccgtattgcccaagaaccccattgagctttgcatttgtcctgccccttttcactcttaaaagtgtaccaggcccggcattaacttaaatggccacccctgtatttctcttcctgttcctcataatctacttccttcccatgtttcaaagccctccccaggtacccttccacttggctggttaccgtctgtggtgaagcgcctgcactcctcgggagacatgcctggcttatatgctgcatccacataaccatagataaaggtgctgccggagccaccaatggcaaaaggctgtcgagtcagcattcctcccagggttccatatacctgggaaagggatcctcaggttaaagaatcatcaagcccttccttcccactgagacattaagtggtctctgcaccctgcaatgaagccctggtatctcatatccccaaagtactatgctttcagaggtagtgtccttggaactcattgctagaatgacataggacttccatcttcctctgcaggagagtggggaagcccagaggagagagtgctttgggagaaactcacctgacctccttcacgttggtcccagccagctaccatgagatgtgcagacaagtcctctcgatatttatagctgatatttctcaccacatttgcagcagccaaaacaagtggaggttcctccagttctatcctgagggaaatattaggaataaaggttgatagaattttaagtctcattctcctatactgttaccatcatccctgctaaacgacccctgaaaactgtaactgcaatagctcaaactgcagcctccctcccacatgtacaggggaaccagagtcccacaccaccaactggtaagaagctttcaattgctcactcttttgctcagccccacccacataactttcttttggctgcaaggaccctgctcttatggggaaaagcagataaggttacttccgtcccaacgaccttgatttctcgtatggtaactgcctgatattatggtgggtcacaatatcaccttcttcctgattatttatatcaggatagtgatttacagcttttaaactgtgttcacatatagaatgtggttctcaaaataaccgtctcatgaggtactatattatctccactttacagatgcagaaactgacagattcaagtgccagcaagagccgaaacaagacttttccatttcccagtgtccagctcctggaacagcacactgtacagggattcatgcaggttgggggagctctagtgggtggggagtcagaactccagagcttcatacccatggagctccagctggtaggcggccatgtcggccacggcttgggcatcagcagctgaaccagagagtgcacagtagatgcgctcgtgcagcggggacagcttgtcaaacactcggttcaccaccgcctcgctgtcaggagggagtcaacagtcaccaagttaaaactcaggttttttttttttttttttttttttgagacagtctcactctgtcacccaggctggagtgcagtggatcaatcttgggctcactgcaaacttcgcctccctggttcaagtgattctcctgcctcagcctcccgaatagctgggattacaggcacccaccaccaagcccagctaatgtttgtattttcagtagagacaaggtcccaacatgttggccaggctggtctcaaactcctgacctcaaatatctgcccacctcggcatcccaaagtgctgagattatagatgtgagccactgcacccaaccagaactcaggaatttttgagggtgatcattcaatgtctctcaaatttctttgacaagagaatagcatgaagtttaatgcttggattaaagcaggaggcaaataatcatctcagatattattaatcactgcagatgttaatcaaaattaggcttatttttcaggcttagattttataacaaagcaaaaaatgctaaggtaagaaaaatatgcctcatcaattttctttgctattaacaatcttgagagagttatgttctatggaacataatgtcagtaatattgacctaaccccatatactcattttgcatgtgaggaaattggttaggagtgggagaagagacaaaatagttcaatatatggtaaatgagaaaccaggtatctgcttgacagaatcatctttttgatccctaagcacagatggaaagaagaccctcaaaaatctatctcctgtccccctctcagaccctattcctttactcatccctgtacactactgggacaggtcacatacacattcagaccccagatcctcctccacaaattcagagacccaagcacccaccaaatagcttatcatagtggcttttggggaaggtcaactccattcctccaaggctccagtttgccagtcttttcatgaatgggtaaggaaagtgtgtatttgaggccattagcttctttccaaatgcatacatcttcacttttactcaccctgcagacactcgggaatcagaacccatcacaacgcccccgtcaaactccactgccatgatggtggtctgcagagacacagaatatggaatgtcagggcaagaacagccttgatgccctcatgttagagaagaagaaacattcccagagaggcgaagtgactggctcaaagattacacagtaacaggccagagctgactgtcagtacaggctttttttcccttcatctttccactttctctattgcttcatccggctgcaggggaatgccacagcccagctgtgatacaacacagaaagaactgtgtccctaagttccaacttgcctagtggaatcctctccactgtagagaggtggagatgaggctcctacaggtagaagtgaagcagctccgcaagtgaaaattatctccaacggaagggctcatagtatgtgcagatgtggtgtagacccaacacagagtaattgactatgatcttgggaaacaaggtcagtctatttttttttttttggtccacaatcctccactctcaccccccatttcatcagaagtgagctcttccaatttactgaacattggaaaaaatcgaggagggcagtggttagcatggccaggggcaaggcaggagagaagcagcaaggaacacatacagatggttgaaaataaaagtttcagttatggaatttccgatcaagaggtaaatacatatctcagcagccagggaggtaaatttgtaccaagagataatttgactgagaagtttaagctgacttttccaggtcaagaaaagaatcaagaagaagtgagggaagataaagctacatttattctactattgagttggaaggagccttaaagatcctcggttcaaatgaggaaaccaagtcacagaaaatgcaaacgacttatgcaaagtcacacagagttaatagtagacctgggactaaaattcaggtctaactcttatcccttgtttccacttctacttcctacttgccactgctcatttggcagtgaggggagatttcccaaattataagtggtttcactgtgtctttcttaccaggccgtaagttactctggccccaaaggacgctcctctgagtatgctttccgacggaccgacttatcatgaatagagggtcaaagaacagggttaacttcaagttagaggctattcctctctaacaaagccgcccccaagccacgagtggtggcagtagtccagagcagaagccagccagccagtcttggggctgccatctgccccaggcgcccatcctaagcaaagtccccccagtgggcacatgggagtgggcagggaagacacagggaagggagtaaggcagcatctgggccaaggagaggccttcctgggtcaagctagggaagggcatcactagttaacacagaacgcccattatcagtgcttgggctaagagttgcccagtggcaagtttatcaaaagtctgtgtgatgagttggtccttctcaataagtgcctatatttccttctcccaagtgctgttctacttcacccagggcaccatttcctcatctctttgcaccatccccaaccccctttcttgatttaaccagcccccactgtccgggaccagagtgaaagcgaaagcgctttagagtagcttcccgttgacgcttccagctaagagtcaaagcacccgctttttccaccagcctcgcgtgcctgttcccttcacggacactctagacgacccccctcagaaaagaaatactctatgctcattgcgggttgcaagcgctggctgctacaggcgacctccctgcgctcccgttggtctctgcattcacttctccgcgcgcgcttccagggtcccctggccgctgcatctcctccacccctctgccaaccctcaagcccagacccattaccccggtgtggacttctcccgcccggggtaagtccccggttggtgctcccgcccgcagcatccctgcaaggcaccgctctcctcgccgcctggggcactggtttccaacctgggacagcgcacaacgcgcagccgacagccccgccccttcgcggcgccgccaggaggcgcctgggtgctgcggggctgctttgcgcgcggcgctaacgtgtgtagggcagatctgccccgagacaagtgacgaggcagccccgccctgaggctggggtgggaaaactggtgcaagtggaaaggcaggaggcagggagaggcgagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccaggcccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggtaaggggaacgcagggcaagaggggaggacacaaggggactgggacaggaatcaaaggtaattgtcagtaaggtagagtagcgtgggttctgggaaatgtggagcgggagaaggactcctagcgtgggtcttggaacaccacttcggtgtagaagaaacggcactggactggcgggggccagaggttctgggctccattgctgaccgggtcttgattctttgggccacgccggaagcggggaaatcctttgctctggggccgaagggcggggcatcctcatctctaacaggaggcttttctacttcatgatctccagccttcctaataaaatcctgaaagttctggtagagcaaccacagggtagtgagttccagggcagcctatttaggttcgggattgagacgtcagtgtttcctttctgctgatgccctccaggataatggtgagggggaggaggcgtggtggggccagtctgactggaactgacctacttagacttaatatttgtgcgtgacctctcttctctttctccaggggagatggccattccattctttacgggccgcctcactgactggattctacaagatggctcagccgataccttcactcgaaacttaactctcatgtccattctcaccatagccaggtctgggggctgaaaatggggcaccctgcaaatgagggagttggaagttggggctgctgtccgaaatgcacttatatggggatacctgggaccttcagtctgttccctgaacacaccctgatcccctttttttccgggttctttatagtgcagtgctggagttcgtgggtgacgggatctataacaacaccatgggccacgtgcacagccacttgcagggagaggtgtttggggctgtcctgcgccaggagacggagtttttccaacagaaccagacaggtttctcctgaaactctttcattatacgccatgtactgttcatatcctcatacatctgctttgatctcccccctccccgctctctctctctcacacacacatacacacattgttccttctcattcttgatataccctctccctgtctctctctctctgtctctgtctctctctctctctctctcacacacacacacacacaattgtttttctcattcttgatatacctcaggagcaaaatattgtcctccttaccttaagaaaaacctagagttttcatctagcattttcttataaatctattcctatgtatccttagatagaaaccatagaatttcaaacctggaaattttgagctcatagagaccaactgcctcatctgacagagaaggaaactgaggccaagaccctaaatgctgaaactgcacagttacatatggctagagacacacttggggttagaaccctggtctcttgagtgctccacagacttcggcatgctttctagcagcactagaagctgtacagttacatatggctagagatagacctggggttagaaccctagtcccagtgagtgctccacagactttggcatgcttcctagcagcaccctcctcctccatctctgttatgtgaccagtttaagctcttcctgcctgtgtgtatagcatgggacatacaggttctctagggaacagaaagctttcaggaaaatggaaattcacatgtgcattaatgactttataattaaaatgaaggtcaggcctttcctctttaacactcatcttccctgcactgagatttgcagacctctggagaaccctaaccttgtttcctgcagcctccttagaaccccatgttgacacccctgaccctggcatcctggctcattgttagttcgtctcatcacttggaacctgtctgattcacctcactctcttctccccaaccctgcaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccaggtatgttcatggagttggcccgctctacacagaccctcatctcccagacttggcagactcagttcctctcacattgctttcagtccagctttcctggcacccttactgattctccatcttcatggaacaccctgtccctgtggtccatgttcccaggttgctcaacattaacctccatactctctgggtcttcttttctagcttctccccacaatctgtctttaagaatttgatccccaacccgttctgagtcattttcctcttcctcgtatttctttagcatccaaggggcatagctgtgtctctttctcttttctccttttcctctgtctcttctcacctttaatttccaaataggtaactcaggtattagtgtccctgatggtttgccaacccgtgtgacatctcttgtccatgtatccacagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtgtgagcacctgaagatgaatacccattcccttgtccttaagatgccgtgactccattcccattcctatgaccctgctcccactccttctttactgggaaatggttggttcagtattttcgtcctagcaacctgaggctcaatgactctactcagtgtccctagccccctccctctctttaaagatgctaggtggcttcctttcagtatggtacataaaatccacccaaccatgtggattggagagatgcgtgtcttccagtcctagggccttcctttgcctctcaggggaagtgcagggcgccataaattcttgcacctgggactgcttcatgctggtaccttgtagatttgttagtgagagtgatgggaatagtggaagccagggatgagggacatctgtgatgcactggaaagagagctacgccagtgatccgaagatcctggcttgatgatgcaatttacttgtcttgtgatcatgacaacaaatttaccttctctgagactgtttcctctttatttatttatttgtttgtttgtttgtttatttttacttattattattatttttgagctggagtctcgctttgtcgcccaggctggagtgcagtggcgcgatctgggctcactgcaagctccgcctcccgggttcacgccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaattgcaggcatgagccactgcgcccgactggttgtttcctcatttttcaaaaatggagtgatataaccttctttataaggctcttcatgtattagctgacatcacatgaatgaaagccttttgtgaagagtaaaatgctccccagacaaggtgatagtggtgatggtggtgaagataactgtgacttgcatgatgtgcattgagtcagactccatggggtctctggttcattctcctgtctgcctattgagcctgccgatgtcacttaggagacagggacttgatatttccttcaggttaatgactgtggttctttgtgtcccctccagatttctctacctcagtccctttttttgtggtctctttatagatttcaggtatgctgctgaaagtgggaatcctctacattggtgggcagctggtgaccagtggggctgtaagcagtgggaaccttgtcacatttgttctctaccagatgcagttcacccaggctgtggaggtgaggtccctccaccttcactccccagtgtgattccttcctctggcccagcaccatctgtgtgatgtccttccattctttacccttcttgcttcacataatgctggcaagcagactacctcactttcactattcttacctccctctaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggtacaacctaccactccctgtattccactggccccaactgcaattctgccatcctaaattttcttcctgccttcagcctgcttactgccaagcatatatcctccctaaccctttaaaggcaatggtaggcatcatctgttccataaatcttccccaaactcaagaacccagtttgggcttccaaagagaatgagagaagaggtttcgaagagagtgctctcacgttccaaggaattgctgcagcaaaatctgtgtcttcggtcttccatctttccttttcctttgtaatttggaatgtgatttttccctttcctggtggtatctgacatcaagtgtgtggcatagtggtgctgggtctctgcccttgtctttgccgcttcttctatctctactccttggggaggcatcacccagaaatctgtgcatgtgggagggtaggagtttctatatttccctgtttttcttctggggtaagacatcatgctatgtaacaaggcaatgacactctcaaggttagaggccttggtagcctcttatcgtgtgcttctctggcctctaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtatggaagcaggtggcttgaaggagggcagggagcatcaaatacgaagagcattcttactgagcactctgaaagaggggttagggaatgataagagaccttgggtggagatggtggtgtagtcaggagggaggtagtatgattttgtgacatgttctcaataaagattttgagtcttcgatctctagataaccatactcccatgtgccttgttctatgactcttcatcatatttcatctcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacaggtactctctccactcatctcaccacccagccatctttacctttgctgaaaccccagtagtcttgcctttatccttcagttcctccttactcatggacatcaatttgaagttgtaagatcatgctcctatggcttcttcatcctgacatcctcaggattctgttcatcttcccagaatctcccctatccagctacaaccgtcagatcttggtgtgtgtgagtgcgtgaatgcatgagtgtgtctgtgtgcatgtacatgcgtgcacacatgtggctataccgttctcatcttggccctttgctctgcagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtgaggcagtcatcttcttaatggctatatcccacccaatcttgcttcttttatacatcttctgttagttttactaacatcataattatacaaaccagtccttgcagttctcagttcccaaatccagttccattggatgcctccccaaggagtagagatagaagacgaggcaaagacacctagaatcagttaaaagagactatctacaaactacagactgaatttctttctttctttccttttttttttttaagacagtgtctcactcagttgcccaggctggagcgcagtggcacaatcttggctcactgcagcttcaacctgctgggctcaagcgattctcccctcagcctcccgagtagctgggactacaggtgtacaccactatgcctggttgacttttatatttttagtagagatgggtttcaccatgttgcccaggctggccttgaattcctgagctcaggtaatctgcccccctcagcctcccaaagggctggggttataggtgtgagccactgcgcccagtcctatagactgaatttctaaagcgaaacataaggaaaagaccatcctcataatatcgtttatttaaaaaaattattttttgtacagacagcgtcccgctatgttgcccaggctggccttgaactcctgggcccaagtgatcctccctccttgacctcccaaagtgctaggattataggcatgagccaccgggcccagcccatcctaatcatattaatattaattaagctagtctgtttacatgcactgtcactcatttattcattaggaatccttctgagctaggcatttatcatcattctacagatgacaaaatggaggttaaaagaggttgaataagctgctcatatagaggtcatatagcttttgagtggcgcagccttgacccaaattcaggtctgcctgacttgaatgctcatctctttactactaagttatatttccttaaaatcgaatataaaaatgccaagtccatgggtagagaagaggactattcaatagtctttattcttctgtcacgtgtttcaccctagggttctcatttttatcctacttttgcacccttcatgtaaaacagtccttaatgaaacaaagggtttgcggagaagtactcagaatgggaaacgttggtgtccttggggttgttagcagagccagcagtgatcctgtgaggtcagtcccagccctggaaacacaggtgtctccctgggctgagggtagtccccggctctgacggtccgatgtctttcctcaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgtactgtggtttcttatgtttccggcacaccaaacggcccactgccttttgcagcgcacttttcagctgcggatgtctcctcttttatcatcctcaatgttttaccccctaactgcatcaccttttcccttaagctttttaattcctatgaggccccttccacttcccctatccccttaggcccacccccaagaatgtgcaagaccccagccacagggcccatcagggcactagcggccgcagctcagagccgtggcctctccgaagtggcagatggggcgggcgcggccagagcaagtgccaggcgggaacagagggactgggcgcgcctcacaactcaccacctcgcccgctggtccttcctggctcgcctggctctgaagctgcacctggaggggaaacctcagaacagtaggcgggattgcctagtaaatatctcccattcagggaggcccaggtcgtgtgacgtcgacagttgctgggtagatgaggccaacacaggttgcaagaagaggcggggtttagaggcgtgaaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggaggtacctcttactgtaacccatcgccaagtgggcttttgaaggcgcctgttcctttctcgctttcttcggaagacccttgacccatcattcccccgacccccataacgggagagcagagaagccggtccccagtgtgatggtcctggtccaggcactaactgtccttttctcggaaaaggcagggggatgtggaaaagagtcttgttccctccccttcgatctgtggctttcgctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcaggtcggggcagtagggaagcccctagggatgcagggaggcgggcgctgaggagtggagggtcgcctgagaggaggaggcgagagcgggagcgcggggtacagggtcgggggtagccttcagtcccggagagcgccagacccaaagaagaggccacatggggatggggcctgagaggaggaagtgcaagttaggacaaagagttacaggtgaggtgggggctcccaaaggaagacaagagaactttcctgcccttgtccacacacaaatggtggagcctttttcatggggttatcacatgatataggaggtgtgtggtgtcttgggaaacctatgaaatttgcctgctggcctcctctcagcaactcactgttgcgcgacttagaacaagtcacttagtctaggtcccaagcccctcttctgtaaagtgaggatactgttactaaacgtgttttgtgagggttgaatgctttatgcatggaagaaaccctttaagtcactctcaaaattttttagtaatggtaacatgtgcttgctttcatttctgttgtgctggaaaatggaaaaggttgatactggcatgcctcttcttttccttctcccaagccatttccttctagagattggttattaactgtttcatttattgatggttagatcatttctgcatatctcctcaccctcatactccctaaaaccttttcctggagcctcttactacagaatttttcattgcctttctcaacctcttttctcttatcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgagtgtatacgctccagcaggcagaatctggggagctgggctctcctttccacaggaggccaactctgcaacaaagtggaagtggatattgatttaggacacactgggggatctatggggtcatcccttctctcccaaagctccatcttcttccaggtgccttacgggtgaacaaggtgattgagattaacccttacctgcttggcaccatgtctggctgtgcagcagactgtcagtactgggagcgcctgctggccaaggaatgcaggtaagcgaggcctctcatcttcctttcttagcctagtggttaatccctggatctctcagatcattgctccttactcttgtcctatgtggtccatcttagtgctaatagtatatttcacaaaacagctttttggtgataagacccttctcccaaatctcagcctgtgctccactcataagccagatagtacgtcaggtatttagcactgacacatccaccctggcgggacagtatcatttactaggctgcctttgtatgtttcagatactttaaattccaaatctttctctgatctttagatcctacaaaataattcctttccaatgcttatctctttaatcatttcctgccccatcaagttggaaagagctaacctctctttcctcactccaccttgtcctcacccaggctgtactatctgcgaaatggagaacgtatttcagtgtcggcagcctccaagctgctgtccaacatgatgtgccagtaccggggcatgggcctctctatgggcagtatgatctgtggctgggataagaaggtgggtgctctccattcttcatgttcccccaccatgttccctatggatgacagatctgtttcccatcatatactcctactccctccctgacaagatgcatggcatatagagtgcttggttatagaactgtttcagtatatccatggactatttattggcccagatatgaatcattgcatgtgttttgtaagcttgtcccttttgttaaacagttgatttcaagtttgtttttcctttttcatttctaaagttcgatgactttaccaaagtggtttcctaattccaatgttcttgtggtaatattaattcttttgttcactttttatgtctcatatttgaacccccatgttaccaacatcttcctctccaatttcagcctgaaatctttcatcttatagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatagtaagagaccaatgctcccaccaccatgcctgggaggagtcggcgggtggtggggggggtgatttaagattgagaaaccagcctggccaacatggcgaaaccccgtctctactaaaactacaaaaattagccggacgtggtgacgggtgcctgtagtcccagctacttgggaggctgaggcaggagaatcacttgaacctgggaggtggagcttgcagtgagccaagatggcgccactgcattccagtctgggccacagagtgagactccttctcaaaagaaaaaaaagaaaatgattgagagactcaaaggagggagagtagtagggaggaaattttcagagtcagaagaagggcattaaaggcccagtcatatggttttaagcttgcgcatgtgtcttgttgctgccttcaacataacatcagtgacaggaacttgctgaggtgaaaggtgactccatgttcttttctcatttgtccacagtgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaatacctctgtcttgtggctgaatggggttgggcctgtggttgttgggtggggcagaaagtaaagagacgctttttctggagaaggggctcagacccctatctaagaaatgtggcctcaccacatagttcttcctggggtttccttccacactcatctctccaagacctcaggaaggctgctcattgctgtccatggacacttgtttgcaatttcacataggttagggtcctttccatagagaggcacctggggactcctgtgtgttccattgttaatggtttgaggaacagggagtagggcacctaggataactgtttttgactttatagagtaggatgaaaaagcttccacttcactttaatatggtaatcatataaacaccataccatttatcccaaataacactttggagatattggatattgaatataaagacagacattaagggtctaatttcatgatgtgtcatgctgaattgcaagatggcaggactataattttagaggaagaagagatcaggaggactcccctaagtgaggagtgtggggaaaatgtaaaagatccaggttagaagaaagagacacacatcatgagattttcggaatcatgctggaactatggaccatgtcactttccagaaaataaaggaaacaaatgcttgaaagtaggagcatgagcttgagcatggagcttttttcattagagagagattcttaaaatgccagaatgaatagagttgtaaaactttagcgagcccctacttaaaatccctcctccccaccaccactattttaaactttaagtgactccttggtagtcacacaggtaacatttcaaaatggtgatctggaatccaagcgacccttcctttggggaatttgtttgtttgtttgtttttagtttgggaggtggtttcaatctgaagagtcctttctggaataaacgaatctttctgttgcataggaaggctctgggtcaggaaggatatttaaaaacctaattactgttctaaacagtgttaaaatagaacaagaaccaaagctcagtacggggcatttccctcataggctgaaggtgcgcccaacataatttggagtacagactcagaggcacctgaacacgcgccagctcaaggtgctccggctgagaaggacggatgaagatgaacgctcagggcctactaaattcaaagtctgtacgtgaaaatcccctttggcctggtgagattggttggaaccttctatttaggagagcccggctcgctcgcctaaaactggagcttgcatggaagagggcacttttttttttttagacgaagtctcactcttgtcgcccaggctggagtgcaatgacccgatctcggctcactgaaacctctgcctcctgagttcaagcgattcccctgcctcagcctcccgagtagctgggattacaggcgtccgccaccacgccctggctaatttttgtatttttagtagagacagggtttcaccatgttggccaggctggtctcgaacccctgacctcaggcgatccgcccgcctcggcctcccaaagtgctgtgattacaggcgtgagccaccgcgccggaccagaaagaaggcacttcttaatagtaggctcagagcttgaagtagtaactttgagaaaattcagtgattctccaattacaaagcattctccaattacaaagcaaggacaacagataaagttgcccttgagacaactgtattttacttaatgataaagaaacatttttgcagttttatatcccagagtaaccgccactaaaggcgagtgagactcattgcaggcctgtacagtgcgaaccagagttcgggctccagttccgctgtctgcgggtctcgcgcgccccctcccggcggcccagcccagaatgaaggccttggctggggaagcgaaagcgaaagctgcccgagccctgacgcccgccctggccgagcgtagctggcggaccagagccggtagcgaggttgggagagacggagcggacctcagcgctgaagcagaagtccccggagctgcggtctccccgccgcggctggtgagttggtgcggaggggaacctggagcgccaacagggacgcagcccaagtgactacccactccacgctcctgcttcccagtccctctgcacccggcgataggagggagcggagcccggaccacttagctcgccgcggcaggcgggggtgggggtgggggtccggggattttttttttttttttttttaagcacgaggctcctgatggtcatgcttccagctccccagaaggccgaaagctgtctgtcgtaggaggggtgtacggatgagcaccggttactcaggagagctctcagggttgaataggataaaatgagaagccgatggacgggttaggcggagccgggcgggtaggagggcagggacaaggattgggactccacccccatgatttctcatctcgtatccgttgacagagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagtcaggagaggacgttgtgagttggaggtggtaaaagggcctgggcaccagcacattcttgtgttatttttcatgcctctttcaggtgagacattaatccctcactattctggtcgtgtgattgacatcctgggaggtgattttgacccccatgcctttgccagtgccatcttcttcatgtgcctcttctcctttggcaggtaggtggtgggcagctgggtccatttgctagccccaaatctttataggggtcttcacttccctaactccatttctaggccctttcaggcgcaaaacacaaaaatacttaaactaaaatatggtgaatgtagtcaccattctgtttcatctatccattcatttcttccttcgttcatattcatccaatatcttcaaagtttatctgatcttattataggaacaagttatgagtgaaggtagtacaaaaggaatttaagtctcagatggaatgtctctcagttgtctctcaacattcctaggtccatgaaattccatttctttctgcctcctacctcctacccctaagtctgtctccaaagtatctctccagggtcactctctcaggatgggtatgcttctccctctcactcttctttcccagctcatcttgctaatccctgaagatcttactctgaggcttatcacctttctttccagaatcattactcttttcccttcacttgctttcctttctctttctagacatactcaaacaaacaaactgtttgataaggctgggactgggatgaggtgagcgaggcacctggggtgcaaagtttaaggaggtgtgcactcaccttacccaaatcccagccggcctgattgtctctatttttatggtcatacttaatttagagtaccctcgaaaaccatttcattgtgccttcattccatcctggctgctttctgctgaaactacagtcgtgcactgcataacgatgtttaggtcaatgatgggccacatataagatggtggacccacaagattataataccatatttttactgtaccttttctatgtttagatacacaaatacttacttctgtgttacagtcgcccacagtgttaggtgcagtcatatgttgtacagatttgtagcctaggagcaataggctaaactacatggcctaggtgtgcagtaggctatgacatctaggtttgtgtaagtacactctatgatgttcatacaacgatgaaaccatctaacgacacatttctcagaacacatccctgtcattaaagtacaaaccctcattatatcatgtctgactattccaaacgcctcttcaatatggtaactaaatttgtattagaaacatatattttgtaaaatacatgcttttatgctttatattttttcctctaagtgttactgtagcatgtagttggtctaagagggattttccaactcgaaggatgacagatgggaatcacatgactctggggctccagagaattgtgggggcagggaatttattattgcagttcccatgatgaagtatctatgatgacagagaagggctttgggtatggggcaggaaggagaccaaggcggaggagacgcacagagggacaagcctgagggacgctgggacagaagcaagcactgggatacttgttttcacaatatcttttcccttctattgtagttttctattgtgtctagtacagagtgcactccataaatacttgtaaatttgtacatgttatgattttgttctcacatctagctcaccatgtctcctctttcttcttcctctgtgtattccttacctcttctctctctgtgtgtctgtctctcatttctttctcttttgcccctcctggcatgctttcccctgactttgcgcttctctgcactcctggcttgctcctctgtttcacccgctggcttgctccttctctgcatctccctcccctcttattctcctaccccacagctcactgtctgcaggctgccgaggaggctgcttcacctacaccatgtctcgaatcaacttgcggatccgggagcagcttttctcctccctgctgcgccaggacctcggtttcttccaggagactaagacaggtggggcctggagtccaggtctgagattcccatggacatcccttgcccctcagtgaccttccacccacagcctctcctcctgccttcacccgtatgccaggacctggggatgcttttctcttgtttgggacagggtggagaagcagcctccactgtccctctgcaagtgaaggaggatgttcagaggagggggctgtgtcagagggaacggtcaggagggagtttctgggggccctgcagtacacatggtttcctttttcctcacctgctctgtccttcttaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggtgagcgtgcatgtaagggaaccccaaagggagaataaaactgacaggtgaggaggcttccacatttgtggctagaggatcccctagagagagatgttctcttctcagccattaggggagaaggtatattgtagtatatactacattttgtttgtccagccatccaacaatggatatttgacttcagaagattcatgattctccagaactgtaaacaaaaatgtaaagtgtatgtgaaggtatgggggagggaataggaaggggagatgataggcgatgataacttttcattagcttctcaaaggagtctgtacatcccccgcccccactgcgaagattaaaaatggtttcttagaggcttttaggcagggagattttccctttaaaatcagcagaagaagtctggatgcagcatagggaaaggaggcgtcatcaggaagtcctaagtctgaatgtcagctccaccttctctttttctcttatattgtggtaaaacatacataacataaaatttaccatttcaaccatttgaagtgtacagttcagtgacatttaggaaacccacattgttattgggtagccatcatcaccatccatctccagaacttttttcatcttcctaaaatgaaactctgtacccactaaatagtaactgcctactacccccaacccctggccgctggcaacctccattgtaccttctgtctccatgaattgtgatgactcccggtgcggtacgtaagtggaaccatacagtatttgtctttttgtgactggcatattttacttagcgtaatgtcttcaggcctcatccatattgtagcatgtgttagaatttcctcccttttaaggctgaataatattctgttgtgtgcatatatcacattttgattatccattcatctgtcaatggacatttgcgttgtttccaccttttggctgttgtgaattatgctgctgtggacatgagtgtacacctgtttgaaaccctgcttttggttcttttgggtatatacttagaagtggagctgctggatcatatggcaattctatttaacaatttttgaggaaccatgtattagtccatttttacgctgctgataaagacatacccaagattgggcaatttacaaaagaaagaggtttattggacttacagttccatgtggctgggaagacctcaaatcatggcggaaggtgaaagacacatttcacatggcagcagacaagagaaaagacagcttgtgcaggggaattcccctttttaaaaccattatatctcgtgagacttattcaatatcacaagaacagcatgggaaagacttgccctcatgattcaattacctcctacccagtccctcccacaacacatgggaattcaagatcagatatgggtagggacacagccagatcgtatcaaaccaccatacagttttccatagcggcagcaccattttaaattcccaccagcagtgcataaggtttccaatttctccacatcctcatcaacaccactttctgttgtctttttttttaatagccattctaatggtgattaggtgattaggattatctcattgtggttttgatttgcatttccctaatgattagtaaatattgagcatcttttcgtgtgattttggccacttatgtttctttcttgaaagaatgtctgcaagttctttgcccattttctgatttttttttaagttgtgggagttcactatatgttttgcctattaatttcctatcagatatatgattcacaaatattttcttgtatttcatggttgctttttcactctgttgctagagttctttgatgcacaaacgttttaaattctgatgaagtctgatttatctattttttgttgcctgtgcgtttggtgttatatccaagaaatcactgccaaatctagtggcatgaggcttttcttctacattttcctaggagttttatagtgttagctcttatgtttaggcctctgatccatttggaattacatctccacctttcttaactatctgtggctccttgggaaaactacccttctttcctgattcagacactggggatgggaaaattacctcaaatgaaggttaaaaaaattgcatgtatctcctatactacctaacactgagagctcaataatattttgttcccttgctccttcactcttattccttctggaaagaagagtaaggaagagggagagaaacagtttggtatttttaggtagactagggagcatctcactggctggagtaagatgtgggggcctgctgtctttgcacatcagccctggtgtttgctggccctcttttccaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtaagataccagagtggttgtgaaaggagcccaggaaagggggagggcaagggaagaggaaactacagctggttctagaggcctttgcagctcagtctcatagaggcagagagggggaaagaatgggaagattcccagcctcatctctttcttctcctcttccaggtgctgcacttgggggtgcagatgctgatgctgagctgtgggctgcagcagatgcaggatggggagctcacccagggcagcctgctttcctttatgatctaccaggagagcgtggggagctatgtgcaggtgagcgagaagccaagcctgctctccttttttccctctctttttctttgtggactcctgggccttgggctttatttgttctttttaacaatacaatacaaaaccaaaacccgcaagtaattttgctatggagaattttaaacatatgccaaaaatgagacaaaataatattacaaactcacatgtatacatcctgtgctttaacaatgatcaactcatgcccaatcttgttggatctgtatccccagccacttccccccacccatattattctgaagcaaatccaagatattgtatactttcatctgtaaatatttcagtatgtttcttaaaaatacaaacatctttaaaagtgtataacaacaaagccattatcacaccaaaaaattaacagtagttcttaaaatttatcaaatagtcaattgtcaaatttccacttgtggtatccatgtagtatatgtgtatgagtgtgtttattatactttgcttaaatcaggatccagaaatggtccacatattgtgactggttgatacatcttttaagtctgtctgtctatctatctatccatccatctatccatccatccacccatcaatccatgtatctgtctaaaagtttcccttgcacagtttatttgttgaagaaataggttgtttgtcctgtggagtttcttagggtctggattttgttgactgaatccctgtggtattatatgctcttctgcctctgtacttcctgtctattgatagataaacctagaagcttgtgagattgaggggttttttttggtctttttccagcaacagtactttttaggtggtgatgcattcttcctccaagaggcacacaatgtctggttctctatttgtggcaacatcagccactgatgagcagtacctacatccatgacagaattagggctgcaaaagggagatactctatcattcttcatgtattagctgaagtagtctatgaagggagacttcccctcatctaccatttcattacccggtggtacagtttgatgaggaaaggcagagtgagcatttagatctcttcctacatttaccagttctcaaaaacagctacttcatccagggctttatttaaacattttcctagacacttgataaacatcttttttgtgtagagaactgcgctgggcactctgacggctacaaaggtgagttgggcacagtgcctgcatttaaggagctccccgtctaatcaagcaagacagaactgggcacaagtaataggaagcagtaactgaaaagatctggggctagaggcaatgctgtatggtaggagaagggactgtatatcctttatattgcaaattggaacactggggtattggtgccacttttaaattccgtccaaattgtacatttaaaagtggagaatctcttttgagtatggaggaggagcagtgcagttgtgagtggagtgtgtgaggagttgggagggtggtttctggtagaagtgtgtttaattagccggctctcccattcctgttttccagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggtgcctgaaagagggaggaaacctggacccttgctctctgctgctaatgcataattggacatcacagcctatagttcatttgcctctgagaacctggtcttgcctctgctaagaagagaaatggagggattttgagggagaaggggcaggcccttaactctttttctggttttctaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtgggtgaggagggagaagacaggggacaggagaggggagcatgtacagagagaggatgggagatccacgggaaggcgcaccaggtgttcattctgagggaggtaggtggggaggacaaaagggcccctgccttgggggtttacacatagtcctctgcccctgtccctgctgcacaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacaggtatcttctacaaattgtaagcttgctccttcagtaaaaaagagaaaatcagacttactcttagtggtgaaggtcgtgtccctgtagcttgatgtttgctgttcctctgccctttcctccattcctacgtctccttccccacacactgaattcttcagcctccctcttgatcaagagtctttgtttgcagagagcaatgcagcagtggtgctccctccatgggcagccccgtcaggtccccaccccatggccctcctcccactgggccctccccgcactgggccctcccacctcccgaggtcctactggaagtacctgctgtgcacttgtccctccttgtgtgttgtctgtgtcacttgtatctgaggaagggaatttctctgatttcctcagatgtaggggagaagggaagccagctggctgcgggacagaaacaacgtctggccattgcccgggcccttgtacgagacccgcgggtcctcatcctggatgaggctactagtgccctagatgtgcagtgcgagcaggccgtgagtaccgtgagagggcaggggacagtggggcctgggaggggcatgctgggaggatcagactgtgcagaattgggcagagggaggacgaaggacctactagtggaaacagtctgtgccttcttggggttggggaatggaatccggtggtgtgagggcagccccagttccctcctgggcttccattcctccagctgtggcagtacagccgggagagaagggcagtccaggcctttatctactgccctttcctaccttcttttatttcacaccttctttaccctaaatcataagagatggtgcccaggtggatgtggtgtccatctcattcctgtctttctgaggcactgtgatcaccccttcagctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaactttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggagtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactcctactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattctattttatggaagttccatatttcatttatcctgtttccttctactgatggctagttaggttattggaagtcttttgctgttgctagttagtcttgtatagacattgtaatgcacatgtgcaaaaatacaagtatgatacaatcttaaaggggagttgctgagtccaatatatacattacaaatattgatagatattgcaaaattgccttcatagaggctgtattaatttatagttccagcagcaacatatgagtttatctgtttctccatatatatatatatgtatataaccaacagacagtgttaatttttaaaattttgacaatcttctgggtgaaagtagcattgtattgtagttatcatttgctttttaatattatcatgtaagtaacagagatactaaacccagaaggataagggagcaaagatgagaaaaataaacacacacacaaacaacaataacaaatctgtctaaaatattggaaaatcagaatgagaaatgaaatatgactgtaacgataaaaatcagtaataaaaatgactattaaatttaaaaataaggcagagcaaccacaagtgacatgagaatgaggcagacaaagttaaagcacctaaagtctttgtcttgtttgaaaggagggtagagatattgattaccttcagatgctgccacatttggtaaacatgttaaaaatataagactgacttttaactaatataattagaatttaaaattcctaaatcagtaaggggaaattaaataatactttaaataaaaatgtaattgatttaatataagtgatgcaaggaaaacaaaagaagcaaagtaagacatagcaaatacagagcaccatatattgtaacagaaacgaatgtaaatagcacagtgatcacaagtataaatagcttaaatatgggagttaaaggaaagttctcagattagattaacaatatcgcaaaatccagttatatgcccttcataagatcacaagaaacctaaaaacatgaaaatgttaaatcaaaaccagatataagatacacaaagcaaacactaacagaagacagaaagacagcttatgtaattacagaaatatctaaacatatagtctaaaaccaaaggcattagtaaaaacaaagacagccattacatagtgataatgaagtcaccagaacattatactaaaactgaatcagtttgcacctagcaataaaactacaaaatatgtaagaaatataggagaattataggaagaaattaattgagaaattgaaacacatttctcaatgattatagaataagtggaaaaatgaataaggatatcaaataagcctgttgatgttcttgtctgtaacatctaggaatcaaaatatattctttaaaactaataaatcaagtgctcgtatttacacatttaagactacaaaggtagacacacacacagaaagaggaagggagaggatatgagctagttttgtgattgttcattatttaaaactaataggaattatctaaaggaagagggaactaagtgtattatatacaaataaacttatcaaagcaaccttgaaatatacaccttccttaatatctgaaaaggtaaaatttttaaaatgcacaataaagacatagtgaaagatttttaaaaatactcatgtaaacattatacttaacagaagttaatatctctgaattagactgaatctatttgctgtatgaataattataaatgggcttcttaactgaactaaataaatgaaaatatttttaaattagattaagataaaaactctattatttgcaatatgcaaaagacacctaacataaagccactcagaaagatgtattcattattttcaacaaataagatgatgggcaaagacataacaagagaaggcaaacaaaagggaagcagaggtcacattcgtcttaccaaacaagatgaaattcagacactcctcaccaaaaaaaaaaaaaaaaaaaaaaaattgagtgtgacagaggcacttataatgtaaagtataaaattcatatgaatatatgagacatgtgtttaagttctaaataccaaataggtagctcttataaagcagaaattaaggtagatacaaggaaaatattcagaaatgtactaccaatagaacactttaattccctttccctggactagaccagttaagtggacaaaaaaataggctgggcctggtgattcatgcctgtaatctcagcactttggtaggccaaggcgggtggatcacctgaggtcaggatttcgagggcagcctggccaacatggtgaaaccctgtctctaccaaaaatacaaaaattagctgggtgtggtggtgggcgcctgtaatcccagctacttgggaggccgaggcaggagaattgcttgaatctgggaggcaaaggttgtagcgagccaagatcgcaccactgcactccagcctgggcggcacagtgagactctgcctcaaaaaaaaaaaaaaaaaaaagtatgaacacagaagatagaagatattactatcaataaaaaaatagatatgctacatctatatcaaacttttaaaattgaaaatagaggccgggtgcagtggctcacacctataatcccagcactttgggaggcctaagcagtcggattgcttgaactcaggagctcaagaccagtgtgggcaacagcgaaaacccgtctctacaaaaaatacaaaaattagccagatgtggtggctcgtgcctgtggtttcaactacttggctgaggtgggaggatcgcttgggcccagttcaaggctgcagtgagctatgattgtgccactgcactccagcctgggcaacagagtgaggccttgtctctaaaacaaacaaacaaacaaacaaaaattaaatggctcaatggcatagaagaaaatttttttatgaagcaagtataatattgatgttaaactatgacaatgcacaaatataaaaattgtagatgaatttacttattatactgacacaaaaatcctaaataaaacattgcaaacagattctagcacagattaaaaaacacccattaagatcaaggggttttttttgttttttttttctagaaaaccctttggaagttcatgatattttgaatttcagtggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaacaatgtgttctctaaaagtatgatttaatattctacctagaaactcagaatatttttcataactcctccagggcagtgtggattatgttgatgtgttaggaggaagtagaaggaagaaaatgaattgagatgtacgttttacttccatgtcaaagtcaccaaaatagcagttgaagggatatttgtgtcaggcaatagggagaataataattttatgccaccctcaaaaaacaaccacacatacacccaaattctctcactcctcagagaaaggggaaggaaagaaaagagagaagcaaaatatgagcttgagtgaaaaatcacagaggagcctgtagctatttagggagggctgctggctgaagtcaggcaggaaaaaaagatcaaaacaccctgccctatttttcaggctcgttcaagtagaagacaaaaacataaatacaggagaaaggaagaaaaccacatctttttcctcttgtctccccagaactgaacagtgtctctgataagcccaggcccttctatcgtagacactgacactatgcacagaaaatgactcaaaaacgcttctaatgggggtgaatctgatgcttcagtttatttaagatgtaccagaggccatctaaggagatccatagcttgctaactgaagcttattgctttctcttcttagttcccatgccaggctctatgccattccttgcttgtcatgtgagatcactgatttcctttggttaggtaggatatgatttccttacagagatctgtcctgacaccaaacagctatgatgaaattccttggttattttccctttttgtgtaccttatcattaccggaatgctaaagctgtaggaataaagtttccctggcttcccaagaaatacagtgtgacagaaaaagtatagcctagggacttactagttatgtgaactttggttcattccatccttacctcatctgtaaaagggagatcatgatagtatctactgcaaagggttttgtgtgatgattctctctctttctctctctctcatacacacacacgcacacatttatataatgcttagaaaatgaactcataataagcaattgacaaacattagctattattatgtaggcaagtcagattttagagtttgtgagccttagacacatttacagagaagaaagagcagccctcctaactttctggtccagcgccatatcctccacttcctccccatccccacatcccttgccatttatcaaccccctctctcctctaaatctaaatacaggcccccgtttgatccatattgtctaggcccttcctctcctctccacatggcccttccttcagctctgagggaagctgcagaagccagccatggtgctgtctacaaagaaggggacacacgcctcttccacccgctcatgctgttactgcatctgatcatctccgtgccgtgtccttgttcacttagcctgtgttgagtgtttgtctccatttccaaatgcaataaaacatctgggaaagactaaggtaggtgtgggcaggaagaagggaggaagttagacccagtggcttgagtgccctctgatgcctccttatcctcggctccacacaagccctcgccagtgtgagctccacagccatccacctggaggaggagtactcaaaaccagggtcaaatgccttgtactcgggggtctaccagtaagcctgtggccagccttccacttcatgaatcgtcacatttacatgagagatgtggagggagaggggtcagcctcctagctcctgtcctgtagcagttaagtcaagtcaggccaggctgtggtaaccaagccagtaccttctttaaagaacagttgtttctcattcatacagagtgtgttgtaggtgtgagtgattccctggggcagctgctcttcatggtgactcagctaattagactgcttttctactgggattgtgccatctcaacacaaggctgtcttggttgacttggtaggggaggaggagaagagtcatgcacgaggagttaaattctttgaccaggaaccttttgttcactttccattggtgagaacgagtcacacagctccaggagagtaggaagtctagtttctcgttttccatgggcctaggaattagaggatgaacactagcgatgtcttccacgtcttgctctctttttctttacctgttataatctcccatggagaagaaattatttttctgattggtctgatccaggcctctaaccaagggcatttactaagggtcatagaacagtaaaaggttgcacaattgcatctcacctctcttttctgaatcctgcttaattaaaactttaaaaactcacttacagaccacttcttgctcttcttagttatcaaatatattttcttccaactcctttttgacagatcttgccttgttctcagctgactcccttgcaaccatctaaatggaacttcctcattcccctttatcccctgctaatcgtcctgtctttattcttttatctgaagaagtgtacccttcttcccccaagccttatgctctctgtcttagtccatttgtgttagtgtaacaagatacacgagatagggtaatttatgaagaacagaaatttatttctcacagttctggaagctagaagttcaaggtcatggccctggaagatttgatgccttggccatcgacttgaaaaaagtcactgaagtgaacttgtggttaccatgataccctgggttcattcttaacatgcacagtataggcaaatcaggggcacatttcatgctgaaagatgatgtgaaatgatgagtaaacattgccctttaaataataataacatagatggtgaattacaatttgcacttttggttttatttgcttaaagatagtgttttactgtctaggttttactgaaagaatacttaactaaacacttgagtcaaatcattccagtgtaacagtcctcacaaggaggaaggcagaagggcaaaagtgccaagctattgcctccagcccttctatttttattgattgactgattgattgattgagacagggcctcgttctgttacccatgctggagtacagtggtgcattcatggttcactgcaactttgaacttctgggctcaagtagtcttcccacctcagcctccaaagtaactaagaccacaggtgcatgccaccatgtttatttctttaattttttaaattttatttggacatgggggtctcactatgttttccaggcaggtctctaactcctagcctcaagcaatcttcctcctcagcctcccaaagtgctgggattacaggcatgagccatcatccctgctctctctagccctttttaaagtctctaatcccattcaggaggcctctgcattcatgacttaatcacctcctaaagggcccaccttttgatactatcacattggtgattaaattgcaacacttgaattttgagtgacattcagaccacagcattttggagaaaatgtcccctttcttctcttttttctcttcagtttctcctttctacagataccttgcacttcacttgcaaccttgttgaagtctctcctgtcttaaaagtttcttttcccaaaacaccagaactcattccttctgtctaactgtaactttgtacttgttaccaacctctacccatttctacccctgactccccagcctctggtaactcctaacgtactctttacttcgatgaggtcaacttttttagattccacatatgagtgaaatcacgtaatatagtccttctgttcttggcttatttcacttaacatagagccctccaggttcacccatgttgttgaaaatgacaggatttcatgcttttttatggcggaatagtattccatcatgtatatatatcacatactaattaccctgatttgatcaatacacaatgtataggtgtgttggaacatcatgctgtaccccataaatatgtacaattattacgtgtcaatttaaaaaacccaagaaaagtattttttcttagtgttgtttttttctaaagtgtatcccattttttcctttgttttcactttcaaaattcttgaaagactattttaatctgcggcctttgttttcttgtttccaattcattcttttgaaatatggcttctacctttaacactctgctgtcctcttgaaggttattggtgccctactaaccataaaacacaataatgctctcttagattgtatcctggtgagcctttttgcaaaattttattctttgagaattctctttccatgttttcttttcttttctttttttgtggtcattttggcttataggaaatcgtactctccaaatgttctctatgtcttctatttcttctctgataatccctttactaaatcttcttgaggcatatgcttcagaatgcttaatttacatactcttaattccttcttaatttacacactgcctgtcggcaatgtcaacacccaataagaagggagacctattggtcagaacaggccagggaatagaagaatacataataaacagtctgcctagttcttctagggccccataatatgtcaaacatatatttttacttcttctcccagcccatttttagtatacctaaattactgtcagtgattctgcaggcaaacaatggttgagttgtatgacacaactttgtgaaagtatcctacccagtacctgatgatgcaaaactcttctatcttgattggttgtcaatctgaggagtttccaatcctggggaagccagaaaaacagcgatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccaggtaagaacagagcaattgtttttttccagtgtgtatgcaagaattggcatgggggagtgatgcctttctttgtaagtccaggccacagaccagactggaagtggcttttggtttcaaagaacagtgttcttccctttggcagaaaggtacgccttgcctctttacatgggatggacttcatataccagagccacctattcaaggggtagggaggcaggaagagggaaacattgtgtcttgtttaggatccttattgtgtgtatcaacctcagtcagtgcctgggcgtgttgaaggccttggcttgggttcgagcctgctgggagaaacaacctgcagtaggctgggtcacagaggcaatctgtgattttttggtcaggacacggaaacaaatctcagttggggtatatgtggacaaatgaaactggaaacaaaggttgctccttctgtcatttattaagccactattatattgtcagaattgtactaaacagttttgagaagtaagagaagttgaatagaatacattgtccttgtcctccgcccaccaggtacaagttacttgtcactgttatttttctagcacaggtgacagaatatgcagccatgaagcaatgtgagatgaaagcacatattaatgagcagaaacaggatgtaatgtgctaagaacagaatcccctttgcatgttagtttcattaaatacaaaagaggaacaaacctggccaggagagatcattattctcagagaatagaaaccgccctgagtttataatgtccattaaacaatacaactgaaaaaaaaatcagcacagatgttaaatgatgatgaaaaattcagatttcccccctagtttagactactagaggaaatagagaagagtatacatgctgagaaattacaggctggaacttcatctgaaattagctactgagtgagggataagtggggttcacctaggaaggtcattcttatggctcagttcagagttggaggaggctaaaggaaaggtaaattacaacccaacattaatagcaattatctttcaagtcttgacttagatgcaatgtcttcaggacgtccttcctgacttacctacattattaactccatttgaatttcctttttattgtagttgttgttcttaagtgcataggattggtttaattttacccaatgagttcacagcacattgtaattattggcagtagtgcaagactctctcgtctcttctcttgcctccgttctcattctctcccctccctagagaatccattctaaacgtgtctggtaagtctctaagtatgagagtggcttttagaaatatgtagcattattgctctttatgtgtttttaaaatttaataaatgtcattctctgttgaatcccattctgtttcttttctcacttgacactgtgctttttgagcatactgaggtcaaaggcctcctcttagatccatgtggtctgacgtaatttaccaggcatgggttttcccagaggagggggctggttcatggttttggttttggttttccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaaggtgagctggaagctgaggtctggcggggctcaggaatgtcccccatgtgaacctggccatggctcttctttcttacaagcaattttctgctttaggataaatggttgtctgtgtagatgttctggccccagctgtgatatattatcctcacaagtcagccactgtgatcttggtctcagacccccaaggttctcagggacttcgagggctattgtgccctcaaagagaagcagtaattgtgggagtacctcagaaagtctaaatcctcctgacaggcattgacataccctgttactgatcttgggggctgagacttgcctatactttgtgttcacttgggtgatctgggaaagagattagacatagtgatagtccctaaagaatctcctgtcccagcttggtggttttctttcacggtgtctcatttttcctcccttcctagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagtgagaattagtttctagtactctctgggcctgactcaggactatactgactcaatacagagcctgtgtcacttctgcgtttatcttggtcacaacatgaattattctttcccttgatctgggacagtcacagaaaccagagtccttgggttagggtgggagaaaacatggcagatatctatcctcatatcttccaagaaatgaggagatctaatcacctcattatgtgcttccaaccctatgaactggtgtcctctaattctttggtcttagtatttaggaggcattcttatgggctgtgagaatctgtaaccgatggggggtaactccatgggtgccaactttggtttcgaagaaccttttctaaatttatttatttttctctagctagcattggatttggtgtctagtacagattctgggattccaagaaagtgctttaaatattgggatatttttactaatttaaagacctgtttcccataggagctcagtctgaatattcttggagaaagatgctgagtggcattgcagccttcctacttgggctaatcttccttctggtgggaatcatcatccagctaagggctcagaaaggtaatgagcctgtgaggagtgccctgccacctgtcccagaccttccccactcccaccttccctaacgtcaatgatctgaggcaaggaaagctgattgtgcctctcagggatcaccgggataatttttttctgaagctagaaatgggataagcagagagagtgctgaccttgccagccatttgttcttccctcgggataatcatattgggtcctaattggggcaatccattcttttctcgatttctttccaggatatgtgaggacgcagatgtctggtaatgaggtaatgtctctttttccttgtctttgagtggcagatcattctcccggttctttggccagagggagatgacatgggggtagggaggagtaaggttgctgctgtctggatgggactgtcccctgagtctctggaacggctgtggggggtggtgaggctgcctcctgagaccttcatcactgtgcctccaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgtacattttagtgaattatttaagaaaaacccctgtaatcaagtcaaggaacaggactttgccagctccagcggaagtctctgtacgtcaggccaatcaaagcctctccttcccctcgaaagtgaccatatcctgattttattgtaacctctttcatgtctttgtagtctagtcccccaggtatgtgttcctggacgccacagcttagttgtcttttacgtctctcatacttcactggtttctcccccttcagcctttttttcccccttatgattaatctgttgaaaagctcaatccatttgacctgtagagtttcccacactctggattttgctggctgcgtacacatggtgcagtgtaacacatcctctgccttctgtgcctcccgcaaattggcatctggatgcagaggctggatcagactctggttcaatcttttcctttggaaaatctatacgtggtgttgtggcctttcaccatgagagacataatttccagctgtttctttttgtgatgttagcaaccattgatactaattgcttaggtctgttaatttattggggattgctaaatggtggtattctgtcattttttcttcatttatatgctttattaatgctacaaagagacagttcccttcatttactagtgaagagacacttccctccacttactagtgggctacttagtggtacagtggaaaggcaggatcagtgtttgactctccttttatttaccagttttcaagttagcaaattggtttcctactattaataaaacctacagatggccaatcaggttttacttttcattctttaaataattataaacagaaggatttaaatgtttgataggttttactctattgcaatttttatgcttgttaaagcttatatcctacatttttggtgagtgaaaacttcttcaagtggctaaaaatgaaactgagttcttttgacgcaaatttcttttgataatttctttgttatctgggatgacaacatgtttctggttcatcttgttcatttcttggccagacctggaggtagccatttttccagaaatccctggtttagtttagtgggaaatgacatttaagactataatccagcgttagggtgttttgtcccactgaacccgctgctggagtcacctcaaaagtggcgtcaagggagttaccacaaggaagttcctgaaaccattctgagatggtgtgggttaggattcaaagaaagaagcactaaatgccagggtgatcagtccaaaacatttgtttagggaatttacctacagagggcttcaggagtccttgcagacagcaagagaaaagggatgttctgcctaggtatgtctgcagcgagggggtcagggtatggagcttatatgaaggtttaaggaacctggctcagggctgggacaaagtttcagtgtttagagaaacaacctagatacgtttatcagtgcctgggagtgttcaaggccttggcttgggttcgagcctgctgggaaaaacctgcagctggctgggtcacagaggcattctgtgatttttcggtcaggacatggaaagaaagcagggagaggggcagtgggggagcctaaatagataggaatggtcattgtgtccagcctgttcaatggcaataaaacatttatacatgtatacatttaaaaaaatcagtcatccaggcacggtggctcacgcctgtaatcccagcactttgagaggccgaggcgggcgaatcacgaggtcaagagattgagaccatcctgggcaacacggtgaaaccccgtctctactaaaaatacaaaaattagctgggtgtggtggcacgcgcctgtagtcccagctactcgggaggctgaggcaagagaagcgcttgaacctgggaggtggaggttacagtgagccaagattgtaccactgcactgcggcctggtgacagagcaatactccatcttaaaaaaaaatcagtcttctctatattacttctgcatctcctttcttttataccaagaactctggttttcaaggacacagggacagacacaattagaatgtccatacttatttgcttttcctgagttaacatagacagcagtctaaggataataacactcatacacaaccaccaaaatggctactgaaaacggttgaaattctttttacctacattctccctattacctgtgttctccctttttacctatgttctcccccgctttctagttgaactatgtctatattagttgatcctgtaccattgcatagactacttgctcccttgttagtcttagttctgtgagtagagatatgtttaatgctcaccatcattccttatgttgatatccctgtcatgtggtggttttcaaggtgtggtccatggattcctgggggtccctgggacccttcaaggggcctatgaagtcaagctatttttgtactaatactaagatgttatttgcctttttcactgtattatttacatattggtacagaaatctatggtggtcacgtgaaactgttagtgcctgagcacaaatcaaggtggtgacacaagctgtacaggtaggtcatgttcttcactcgccataagcttacagtaaaaaaaaaaaaaaaaaaaagcaaaagccagtgaccttgatgaagcaataaaatcattagtttactaaattttaaacctcaagcacacatctgtttaatagtcagtgtaagaacataggcagcatttctggtgcatactgatggaaaggcagttgtcctgtggaaaagccattatgtaattgcatgagttgtgagtgaagttaaacattttttttttagtgggtcatcattttccttgaaagaatgactgaaaggcacactgtgattattcagacttgggtatttggtagaaattttctcaaaaataaacaaaatgagcctatcccatcaaagaaaataatattgacagtggaaattggaatttcaagagaaaattaaaattttggaaaacttacgtgtgccacagcttctcactacttaaagatgtttctgatgagattggtggtgatattaacaaatatggcttaaaaaatattgtttaataaaatatgtcaacattttaaaaatctgcgtaaacccatgaatcaataatttacaaataatcaatgcatgatattgcaaagtcatgcataaagatccatttaaagatagactagtgaattttaacacaacagaatatgaaaagttaatatataaggtttcagattccacactgcaactaacctttaagaatctgccatttcttgagttttggtgtcttatcaaggaagaacagttacgatagctgaaatggttatggaaactttccttcttttcccaactgtgtataagagtgaggccagattttcctcttgtgctttagccaaaacaacatattgttacagcttgaatgtagaagaatatataaccaagctagctttattaagccagacattaaagagatttttacaaatgtaaaataattccttttttttcactatttttttgtgctggagaagacagctattttccataaaagtgtgttgtttatgttaacatgtaatgggtttgttattgttatttaataacaaataaattaatataaatgtcactttacataacccatgtaaactaaagcttcttggtgttctcaacaattttatgaataaaaagggatcctgatatcaaaagaattataagctactgatgtagtcatcatgattgtttgaaactatttctcctaggtgcctcaggaagacttaggaaagtgtcttagtttgtatgagctgctataaccaactaccagagactggatggcttaaaaacagcagaaatgtatttttcacagttctggaggctggaggtctgagatcagtgtgtcagcctggtagggttctggtgaaggcctgctggcagcatcttctcactaagacctcatgtggcagaaggaaagggagctatctggaatctcccttataagggccctaatgccattcataagggctgcaccctcatgacctaatcaccttccaaaggcgtcacctcctggtactgtcaccttgggcgttacgatttcatcatatgaattttgggacggcatatacagtccacaccaggaagttcttgcacttcatagtcgaaagtcagttttgtggctataaaaatcttggttccattttccgctcttgagtatcttaaaaagttactacattttcacataactgctatcaaaaagtctgatgataatctaattattaataagtcattgctacttttgctgagtatccagatggtattttctttttctttagtatccacaagttttattggaatgtatcttggttggggggagggcaagatcgctgactagatgcagccaggtgaaacagttctcaatgaggaacccagatgactggcgtgctcctaacagatgttcagacagaaggcacctagagtggacagagggaagacacagaagctggactgaagtgggagaaagctgggagccctacatggggctacagcacatccagactcattcctgtcctccaatggctccaggaaaatgggtgagttgaactggcaaggaacaacccactgtcactatgacctctgcaaccatggcaggaggagacccattgaccaccatggacacttgagttggcaggaagagctgcttagagaagccgtaggggtggcaagccagcgggtgtggagcctagaggattcagtgcaggagcatctgcagtggagcatggccagggatggccatttccctaggctcaacttactcccataggagacattagccctagggaaactgttggtcctgaaatctgtagggtggtcttgcccatcagatgagtctggttctacctgagcaaccgttggtcttctggcctctcctggggccctggcctggccacatctgcttgcaaagcagcctcaggtgctctgtgggcctgcaccatagcttctacactggcagaccatgactgaccagtaagtggagagctccaacgaggaggcccctatgaccaggcaccagcctgcatgctccctccccacactgcagcttcctctgggcccacagcaactccccacatcattttgctggtacatgtctgctgggtgggttttgttttccttgcctcaccagcatataggagtgtaattcaccccccaccaattccctcctgacagccattgcagacagagccttggtgggcacagagccagccagccccactccctccatcatcccaccctgtgctaacactgtgcagagaacagctgatcctcccccaccctgagtgaccactcctgcacagaaaaggcacgcagacctgcacctgccaatgccttgcccctaagccaacaccacttcctgtgtgaccacacacacagttgccagcaggggacccccttcctttcctgcagttgcattgcctctgccactgtggtggatgcctgcagggaggtgggcaccccggcacctgctagtactctgctgcagcttcaactaccactgctgctggtacactcaaacaaggacagatcctcctgtcactgtactatgaaacactttggctgacaccactcattggagtgtagtgaccagtggtctgggagcacttcggactgcaccactcctgccacctcccccaccccccgcccatcacagcggattcctaattctgaggaaacagagaacaaagtcagggccccgtacaagtcccaaagaattacagcatgcagtccaggagttgggagtggaatactggccaaataaaattgtccagaaatgaagtcagttggctgaatccaccttataccacaatcaaaccctcaaagtcatcaaataggataaataggataaataaaaaaggttggatgatctttgctgtccaaaggtcagcagtctcaaagattaaaggaaaataagcccacaaagatgagaaagaatcaggcaagaaccttgacaactcaaaaagccagagtgtcttctgttctccaaacgaccacatcacctctcgagcaaggattctgaactgggctgagatggctgaaatgacagatatgtaattcagaataaggatagaaatgaagatcattgagctacagaagtacattgaaacccaatccaaggtagctaaaaattatgataaaacaatgcaggagctgatagataaaatagccagtatagataaggacataaccaatttgatagagctgaaaaacacactataagaatttcataatgcaatcacaactattaatagcagaactgacccagtggaaaaaagaatctccacacttcaagactggctttctgaaataagatagtcagacaagaatagagaaaaaagaatgaaaaggaaggaacaaaacttctgaaaaatatgagattatgtaaacagaccaaatctatgactcattggtgttcctgagagagatggggagaatgaaaccaacttggaaaacatatttcagggtatcatccatgagaatctccccaacctagctggagaggccaacattaaaatacaggaaatgcagagaaccccagtaagatacttcacaagaagatcattccaaaggcacataattatcagattctccaaggttgaaatgaaagaaaaacagttggcagctagagagaaaggccaggtcacctacaatgaaaagtccatcagactaacagtggacctgtcagaagaatctctacaagccagaagagactggggccaacatttattattcttaaagaaaataatttcaacccagaatttcatatctggccaaactaatcttcaaaagtgaaggagaaataagaaccttttcagagaaggaaatgctgagggaatttcattaccactagacttgtcttacaagagctcctgaaggaagcactaaatatggaaaggaaagacttactagccactacaaaaacacactgaagtacacagaccagtgacactataaagcaaccacataaacaagtctgcaaaataaccagataacatcatgatgacaggatgaaatccacacatatcaatactaatcttaaatgtaaatgggctagtgccccaattaaaaggcacagagtggtaatctggataaagaaccaaggcctattagtatgctgtcttcaaaagactcatgtgtgtcatgcagtgacacacataggatcaaaataaacagatggagaaaaatctaccaagcaaatggaaaacagaaaaaagcaggggttgcaatactagtttcagacaaaacagactttaaaccaacaaagatcaaaaaagatgaagaagggcattacataatggtaaatggttcaattcgacaaaagatctaagtattctaaaaatatatacctccaaaagaggagcacccagattcataaagcaagttcttaacgaccttcaaagagacttagactcccacacaatgatagtgggagactttgacaccacattgacaatgttagacagatcatcaagacagaaaattaacaaagatacccaggacctgaactcagctctggatcaaatgaacctgatagacatcttatagaactttccaccccaaaaagacagaatatacatttttctcattgtcacatggcacatactctaaaatcgatcacataattagaagtaaaacactcctcagcaaatgcaaaagaactgatcataagaaaaaatctcttggaccacagcacaatcaaattagaaaccaagacaaaaaagttcactcaaaaccgtacaattacatggaaattaaataacctgctcctgaatgacttttgggaaaataatgaaattcaggcagaaatcaagaaactctttgacatgagtgagaacaaagatacaacacattagaagctctgggacacaactaaagcagtgttaagaaggaaatttatagcactaaatgccaacatcaaaaacttagaaagatctcaatttaacaacctaacataataactaaaagaactagagtatcacagccaaccaatctcaaggctagcagaagacaagaaataaccaaaatccagaactgaatggaaggagattgagacacaaaaatgattcaaaagatcaatgaatccaggagctggttttatgaaataattaataaaatagatggacttctagctagactaataaagaagaaaagagagaaggattcaaataaacacaattaggaatgacaaaggaggtattaccactgaccccacagaaatacagacaaccatcagagaatattatgaatacttctatgacataaagtagaaaatctagaagaaatggataaattcctgggcacatacaccccctaagactgaactaggaagaaattgaatctatgaacagactaataatgagctctgaaattgagtcagtagtaaatagcctaccaaaacaaaacaaaacaaaacaaaacaaaacccaggaccaaatggattcacagctgaattctatcaggtgtacaaagaagaaatggtaccattcctgctgaaactatttcaaaaaattgaggagaagagactcctacctaactcattctatgaagctagcatcatctaaataccaaaacctggcagagacacaacaaaagaagaaagcttcaggccaatatccttgataaacattgatgcaaaaaatcctcaacaaaataccagcaaaccgaatccagcagcacatccaaaagccaatctaccatgatcaagtaggctttatccctgggatatgaggtttgttcaacatataaaaatcagtaaatgtgattcatcacataaacagaactaaagacaaaacccacatgattatctcaatagatgcagaaaagtcttctgataaaattcaacactccttcatgttaaaaactcttgataaactagttattgaaggaacatacgtcaaaatagtaagagccatctatgacaaacccgcagccaacatcatactgaatgggcaaaacctggaagcattccccttgaaaactggcagaagacaagaatgccccctctcattactcctattcaacatagtactggaagtccttgccagggcaatcaggcaagagaaaagaataaagagcagccaaataggaaaagaggaagtcaaagtattcctgtttgcagatgacatgatcatatatctagaaaaccctatcgtctcagcccaaaaacttcttaagttgataaacaacttcagcaaggtctcaggatacaaaatcaatgtgcaaaaattactaatatttctatacaccaacaacagtcaagcctagagcaaaatcaggaatgcagtcctattcacaattgccacaaacagaataaaatacctaggaatacagctaaccagggaggtgaaagatctccacaagaagaactaaaaagcactgctcaatgaaatcagaaatgacacaaacaaatggaaaaacattgcatgctcatggataggaagaaacaatatcatcaaaatggccatactgcccaaagcaatttataattcaatgttattcctattaaactacaattgagatgcttcacagaactagtaaaaactattttaaaatgcatatggaaccaaaaaggatacatagatacaaaataaggacatgaaaacatgtgcaatgtcattagccattagagaattacaaattaaaaccacaataagatattactatatacctatcatgatggctaaaaataaaaagtaggcacaataccaaatcctggtgaggatgcagagaaaatagatcactcacatttggctgctgggaatgtaatatagtacagccacactggaaaatagtttggcattttctttaaaagcaaaacatgcaaccaccatacaacccagcaattgcactcctgagcatttatcccagagaaatgaagacttatgttcagagaaaaatctgcacatgtatgctcatagcagctttattcagacaaaaactggaaacaaactgtggtatatccatactaggaaatactacttagcaataaaaacgaacaaactggatacaggcaccacgacctggatgaatcaccagggaattatgctgagtgaaaaaaaaaattgcaaaatgttgtctactaaatgattccacttacataacactcctggaatgccaaaactatagagatggaaattaataattgctgtgttaatgaagaagtggaaatgggagggaagtggctgtggctacaaaagggcaaaatgagggatattatagtgatgaaagtgttctttattttaattatatcaatgtcaatatccagactgtgataatttactgtagtttacaagatgttatccttgggggaaactgggtaaaatgtacatgagatatctctgtaacatttcttacaagtgtctgtgaatcaacaattatatcaaaataaaaagtataatttaatacagcatcttaacattttcaacaaaactaagtgtcaaagtatccccataaacctcaaatacaaattggtgaggacaaaccactagtagttgcacgttattaatttttcctgttatggattatgcctttggtgtcaagtctaaaagctttttgcttaatcctagatcctgaagattttctcctgagagttttgtgactttatgttttacatattagactttgatccatttttatttcttcctttgaaatctgcacgccttttttttttctcgcccattacattatctagaacttccaacgccatgttgaataagcatggcgagagtggacatcattgctttgttcccgatctttgggggaaaaatttcagtctttcaccgctgtgttagctgtaagattttttgcagatgctctttatcaaattgaggcagttcctctctatttgcattttctgagcattttatcatgaatggccattgaattacgtattctaatacctcatatatgtacatcattaacttggattacacttctttaaatagctgcctgttctactggttgtcaaatgagctgtatcctttctatttaatgcctacatgaagtttttaaatatggactctatgtcatatatttagtccctttcaggtttccaacataaagtgatactatttcagctacttaagcacttatttaggatttatgcctcatgtagtttagatttattatgagtttgcacttacatttgattcctttttatactcctaatgtctttttttcttaaacaagtggcctatatatttggactcacaatatttatacatcctctgtcaccaggggtacatgtccttataccttaaagcacgtgcttctggagtcctgtcgtgttacatgtttcctctaaaacaaaccctccatgttatttgagagccaaccccacttttcaagttatttaggctgctgtaacctccattaataaaggattcaaaagtcataattgtgtgattctttaggaattatccaaaaaggcaatctgatttattttccaaatatcctggatctgaaataatctatcagagtttatttctatgcttggaaagcttccttggatgtcagcatttgcgattttcttacttagcttatgtagctaagtaagaaatgaattgcttttgttggtttcttagtacattctgtccatcaagtacattgagttgtttagaattgttttgagtcaacagtgtaacaagcatccaaaatcttgtatagtcaattttgtttgactattgtgctagaagatcaatttctatttcctctgttgacaatatcctgagcattttgaagttacacaattgcagtggtaatttagcggaagagtgttaacattttaacctaaataattgattttgtattaaacaaattctgatgtaggaatgtatttagtattaactatatggaattctctataaatctcataaacagagtagttgcttttttgaaggggattaaaaattaaatatcaacattttcattttagaaaataaaaaatgtggctcacgcctataatcccagcactttgggaggctgaggtgagcagatcacgaggtcaggagatcgagaccatcctggctaacacagtgaaaccctgtctctactaaaaaatatgaaaaattagctgggcatggtggtaggtgcctgtagtcccagctacacgggaggctgaggcaggagaatggtgtgaacccaggaggtggagcctgcagtgagccaagatcatgtcactgcactccagcctgggtgacagagcaagactctgcctaaaaaaaaaaaaaaagaaaagaaaaagaaaaggaaaaaatgtcttttttctttttaaaattttcctattttaatatttaaaattattttatcttttttttaaaaaagttatacatgacatggtttaaaacatcaaatacagatggttcctgacttatgatggttccacttaagattgttcagctgtgatggcgtgaaagcagtacacattctggaagaaatgtacttcaaatttgaaatgtcagtctttctctgggctagtgatatgtggtataacactctcacctgacgctgagcagcagtagtgagccacagctcccagtcagccacgctaatgtaagtgttctgagcatgttgagggtaggctgggctaaactatgatgtttgataggttaggggtattgaatgcattttcaacttgcagtttatcaggacacaaacccacctgaagtcaaggagcatctgtatttctacagggcttgttatgcaaaacagctgaccacactgcctccccattcctctttccagacagaaattctagtagatagtcccattttacaaatgagaaagtggaggcttagggaggttaattaagacacgcaagttcatatgggtaggaagcgatggagctatgataagaactcaaatccatatggtccccaagcctgaggtttgagctatattgcttcgtgattacaggatatattagtttcctattggtgctgtaacaaattaccacaatttagtgttttaaaacaacaaaaatttattgttggacagttctggaaattataagcctaaaatgggtcctgttaaattaaattaaatttggcttaaagcggcctctgtactttgaattcctacgtagtatactgaaatctaacttaatgtgtaagaaaattgtaccctaacttaagagcatattcttgtaataaatagctgagtctcaggcaaacacagcagccaagcttcaggcaatcacaggttgccaactgatcagaccatgatcaaataaggcaaatactgagctgtaaacaagctgcttctgtataccacttcctttttctctctataaatattgcctgcccctattgctcagtggagctctctgtacctcttctggtcctggatgctgcccaattcatgaattgtgctttgctcaaataaatcaaaataaatttcatttgttcaaagtttttcttttaacacttgtacagggctaatcaaggtgttagcttgtctgtgttccccttctgaaggctttagcggataatctgtttttgcctcttccagcttgcagcgaccagctgcattcctcggctgatgcccccttccagcaatcactttcctctgatttttgcttctaatatcacatctccttcttctattctcttgcctctttctttcacttagaaggacccatgtaattatatcaggaccacttggctaatccagaataatctccccatctcaagatccttaatctaatcactaatgcaaagtcccttttgccatgtaaggtaacagattcacaggtttcatagattcagatctttcaggggtggcagttgggggcattattccatctaccacacagagtaaagtttcatctggatgacccacaggccctacaaatacaaaatgtctaatatggaatgttctcttaaactgtcctttcttgatgactggaattactaaccacttggtctcccaagcatcttctgctctcgccttctcctctctcccatatacaatggatgacgacacatcatgttgcatctgctccctcacatgtctctgaccctctctctagatccctgatcctactttaattcgagccccatcatgtctggtctgtgttactctaacagttacccacgctgctttctctgctttcaattttatgctcctctaacccactcttcccatcagagtagtctttctaaaacgtgaagctgcccatgacccttcccttactatcagtctgcatactggtcctactgactgcagatcaaagacccaagtccttagcctggtgtgtgaggcatccatccctagccctctgcttcatctgtcacccacccattttaccaattccgaaagactttcacttccctcgaagcctgtccaagtgtccaagccgctcatgctttgttagacttggaagccattctccatataccctcgatcagcttgaatgtcatttccactagaaaattttcctaattgtttgtgacttcaatgtcctaattttacacacatttctgctgtgcccctttgtttgctaatatgtctcctgggtggtaagcaggactccgtgtcttattaatattttccgtctccagaattcagccactgtctgccacacaagtgcataatgagttactatactaatattatgcagccatgtcccctgtacagcagttccctggatctcatggcttcttttttgatttgccttgtttgttaccaacttccatcagtaagacaatctatccaatccttgtcccctttgccacatcacatcctcagggcaataacaaagttgttaagtttatgcaccttctccacttggagcaaggcctcaccatgtcaggcctccgcctgattctcctccctgcctgggatggcagattttgctctagtgggtctccaggccgtgaggtctcctgtcttttatgttctgatccgggtggtgagctgcagctcactacaagtccttacttgtctctgctggcctttagagactttgtactcaatttggaggaactactcttgatggattgtaagtgagaggatttcctggtctccctctggagtccgccagaaaaccacattctctgcttttcagcgttgactgctcatgcttacgtaatttctaagagtaagagcctatggactgtcctggcagcaaagaattcgctcaggattttgcctgaagctgcacttccggggtctcgcttcatcagaagacttcttcattttcatcatcggcccagcgatgcatgggtacctcttagggtttagccccagaatgtactgggggaggggagggtaaagtaggtggggaaggagtcagagtcgtaggtcatctgtggctggagttttgcatccctaataaacgggaaatgaactgaaggaagactgggttttcacgtcaacacgaaggacaccattacgatgctagactaatcatcaaataaaattccagatggaaaaaattcagaaacttaatttggaatttgagccccgctctattatgcaacgttcccagccattgctccgcggatgtaatgtggacttccaccgccagatggcgatcgagaccgtaatttaagttggttttctcaacttcctctggactgagtccccgtgaaaatcccaagtttaacgaggggctttcctcgcgtaaccttcgcttctgcttcctctctcacatcacctcaacctgcgagactctgaaagggataatgagggttggggggaatatggaaattcagggaagggagaggggggtggtgtgaagctttccagaccagccacacagaaatagcgtaccaatagtggtttagagcacagacccccagccagaatgagtaatttaaacagccctacgatgtaatcgttgtgtgcatatgcatctctatgcctctctctctctctgtctttctttcatctgagacagggtctcactccctctgtcccacaggctggagtgcagtggtgcaataatggctcgctgcagtcttgacctcctgggctccagtggtcttcccacctcagcctctgaaaccacagggtcttgaacttctgggctcaagtgatcttcctgcctcggcctcctaaagtgctggggttacaggtgtcggccaccatgcctgtctgctatttaagtgcatagaagaatgcctggcactcagttagtgttaaatatttataaaataaattaaaattttataacactacacacatgttgttgagtatgtcataaatagagacatatttaatgagatgtcaacatatatcacgttaatgaattaagtaagtttgagaatattagagaagaatgataatagattaacggaggaggctggcgcagtggcccacacgtgtattccagcactttgggaagccgaggcaggcagatcacatgaggtcaggagttcgagacccagcctggccaacatggtgaaactccttctctactaaaaatacaaaaaaaaaattagccgggtgtggtggtgtgcgactgtaatccctgctaatggggaggcggaggttgcagtgagaggagatcgcaccactgcactgcagcctgggcgacaaagcaagactccatctcaaaacaaacaaacaaacaaacaaacaaacaaaaaacagacgaaatagggtttgagtatgtagtctgctctcaacatgagatagtaaagtctttgcttcccttatattctgttaattaactcatttgatgcacatcgatgtataaagcctttaacttctatttattcttttccttgaaaagcatgcggaatgccttctcaggactctcccattttttatttgtgaacacccactggcattcccggatacgaagcttgcaagaaggtgtgaaccgccctatactcgtgagcccctggggctctgtactctttccagcccacatttgacctcagtcaatttttaaatgattccagctaaattcttcttaccagtgcccagctgtacctgccttaggtaagcaagcactcaggcaacaactttcctagatttcaagctagttggaagctcaatcccagctctgtgatgggttgaaaaaaattgcgaccttgcaatttgtgtgatttctttcatgttgcaaggaagcatcattgtttccagttctctgcatccccaagcagaaaccagaactctatataaacgtttttaaatggagacattgagaaaaagtacccgagaaaccaatgagatacaggaagaatgcttccagcactaacatgaatggggcttggccatacagatagaagggttggaaactcttacgccttgatttaaactctctatgcatattctgagcacgctggggaatgtactactactaggcttgatttggattcatggctactacctcccacaaaatgataggtcttctgttttagtacgtgagataattcctcaatcgatcttattgctgctatttctgttaagcataaacaatgatttgggtcacaaatttcaatggggtttaaattcctttgtgcatcccaacaggtaatcctcttactctgggctatgaacttgctactgccaagatggatgccatgaaaaaaagagatctcatcaaaatggtcacagagagatggagggcctctgtgtagatggcagggtggtggtggccgtgtaactagctgcccggtgaggagcagcccttggggagagcccaggtaggaccaggagaagcagaaatagagaaaagtgaaagatcgaggtggaaagaacatgagggacaagagctctgcatggccacatcaccagcagtcttgttattacaatgaggatgaagggactgaaaagaggggaagagatggaattcatcaaacaacagtgctcattcatacaaggtaagtatacatgtggccttttctctctctatctgaagatgtggcttactgtaacaggaactatcatgggcattggacggctgtctcatggtgatcccatcctcctctacatcctaaacttttttttgaatgcatttctgtattttgacttcctctctccccaaagttcttgttaacttctgagtatgacttagcttccttattctttgaaatatttgaaacccctaacttcctctcctctgtggtgtaactcacatggcttcttgataccaggaggcactgtctgcatacaacctcatattatgaggatgaaatgcccatgaatcctaccaatctgaggaacaacgcatttgtcttctctgacaaaatacgggtgccacatattctgtaggaaaaggtggtgttgaggtcagaacttctctgtttctctgtctctctctctctggttctggaaatgttgagaatatgagtgaagggaaaaagatgggcaccacgtggaggcaatttcatggtggcatgaaacaattttgggggcatgaatgccatgggcagaacatcagggccccaaaagggaaatacacagtactttctttggacttcagtgctctcttttatagtaatggaaaccacaagcgcagaggaaggggagctgattctataaaaagaagtttatttcctactttaaaagatgattttttgactatcttcccacaatagagccagaggatcacaggggaaagctacgatcctcaattatagaaaatgatgttgggtgcatctagcatcacagaagctttagaggacacagtcatctcaggtacctacagataaggaagaagtaccaatgagagtacctactcgtattcttattcatggaagcgaatcccttcaggaaccaaatcatttagctgctggtagatgtttcttttggctcctctctctcctgagctctcaaacacagacttttttttctgtgtgcctctgcttttggcaactctgttccaagaataagaatatttgtttgtagatgagcttgctaggtcggggatctcttgtatagggagatggtgaatcactgagcaggacacagaggcatgagttgaaacagtgagatgtaccttagtttaaagagaggtcacaagagctcatggaccattattagataaactctaaattagaaaaaagaaccatatttctcttttgatagtcacataaaaattgaagccatactcattctaataaaaagtaacatgcatagctcttcattgcaaagctcatctattattcataacaggcatatagggtctatatcatttttacagaagtggaaatagcatgtaattactaatttagtttattcattagttttccaaaagtgaaataaagaattttccctttgacttcctacctggtaatttgaaagagataaatttgtgactaaaaagagtacttcacatcatacacaaataattaatgcaactgattgacccaagctagtgtgtgtgatattgtgatataataggaagtatatatttggtttctgaccctggttcctgcccttcagctcctaaaactcttggaatctccagagtgataagagtgtcttttgcatgctaatgaggtgactggtggctggggctggtcaccagaaagaccaaggcaggattagagggttgggattttcacccactcacaatctctggggagaagggaggggctgaaggttgagttgactgccaatggccaatggtttaatcaactcaccatgctgacataacaaagcctccattaaaacccaaaagggcagagtttggagagtttccagatagcagaacacggaaagatgcctggaggataggctcttgaagaaggtgtggaagctccgcactctttcccccatactttgtcctatgtgttttgtttttctttatcaatctgttcgtctgtatcctttgtcttatcctatgtaataaaccagtgtatgtaagtaagtgtttccctgagttctttgggctgctctagcaaattaattgaacctgaggaaaggtttgtgggaacctccaatctataattggatggtcagaagtacaggtgatagcaactggcatctgaagtgggaagggggcagttttgcatgactgatccctcaatctgtgggatctgatgctatttttaggtaaatagtatcagaattgaattgatttagaggaacccggtgtctgctggagaattgcttggtgtgggggaaaaatctccacatacctgatgtcagaagtaactgtgtaagacagaaggaaaaatgctttggagttttttgttttttctccccatctctatttatataggttaaaaatgtggctgggtgcatgcccatgatctgagcactttggaaggcccaggcaggaggataactagaggtcaggagttcaagaccagcctaggcaacacagtgagacccccccgcatctctaaaaaacaaacagagacaaatacataaataaatcagtacaagtacaagcctcataatccattatgaaagtgtcagagtgatgaatgccatgggcatagtaacagttaataaagaaaataatgtgttggaggaatatttaagataactgaggctgctacaagcaaaactacagaataatttcatcatatacatttttttttgtttccaaattagatacaagattaagccttgggtctccctggcagtggagggcgattctgatattcacatataactacccacagggcatggattctgagagatgctgataaaagaagttggtgtcttcttggcatttgtccccaaggatcttccaatacccagagaatctgcatttacacagatcatgctcccttgggagcttctcttgactgccccccacaccctcattcgtggcttttcctctttgatctcccacttcagtcctcacacctgtcaacactgtgcttattaccatgtggagtggttagaagatcttcccagagtcaagacatttccagggtcacccttctcttaggcatttcttggcacgactgtcctgaataaaggaaaggagatgaaggtgatgttgagaagcatctagagggctggagtcagggggaaccggctgaggctgttggatcaagttttagccactggtaaaagacctccaagctgcgaatgctattgccatctgtgtaaagtcgcctccgagattagaacatgccaaagactgaagaaagaggtctaggtagcataaagccatcatgtaattgaagtttcttccgtttccaaggacaggaagcgtgcaaatggctctgcgttctcagtaggggtggggctaagaagtgagcctgcaaatggtagtttgggcgaagacttgtgtgatgcatgcagggactcaaatttagtgtcctctgaacacaaacaccctctatgatccgggttaggtatcgctcctgtgaacgttcaaagaacacctttatattctgaggggacaccgttcatcatcagatcactgttgacggaagccaggtgacagctttgtatttcgtgttttcccctttagtaatgtaaaaatagaagttatttctcctttcttccaatgtaggatttttttttttgagagggtctctgtcacccaggctggagtgcagtgacacaaacacagctcactacatccttgacctcttgggttcagatggtcctcccgcctcagcctccttagtagctgggacgacaggcacattccaccggcccggctaatttctttttaaagtttttgtagagatagggctctcactatgttgcccagactggtcttgaactcctgagctcaagcgattctctcaccttggcctcccagagtgttgggattacaagcgcgagccaccacacccagcccagtgtaggaatgtttaattcctccacttgctatcaaagaaaactgctaactttcttatttcctaatttctctttttctatttgcttctccttaggttctgctcttgggtgctatctccttagttttgagaatatgaaggtttgtttagaaaaaaaaaagcagaaaaaattcactggaagatttcacatttgtatatatctttatgaaatgtgacagtgaagtgttagggtagagatatttgatctgattaccattaggataaaatcaaatctccttaccatgtcttacatgtgtacttgtccaatcttgtctcctataattgtccaaccaacccgttctgttccagcctcactggccttcttattctttcacgaagctcacactgtcctccagagccttgcactctcttttgcctggaatgctctcccagatcttaacatgataggaaaacaaaagacaactgtttgtcatgtctactacagtctcagccccatgaggcagagtccatgcccattttccttccatgcaacattcctggcacctagagagtgactgatgcataatggctggtaaaatatttgattaaaaaatattttagtgtatttcctcccccaaaatatacatacacaacagaggcagttattttgtctatatctttagcacattttaggcatttagtaaatttctgttgaatccatatggaattcttcagattgatctgtgaacactttagatttgaaaaaggagaaaatcataaaactaagggtaatggggagagagcaaaaccaaaggcagacatgggaagattctccttatacaaaatactttttccatgtctataatgaacccccaaattatctggatacttacaacagtggtagcaagggaatgtctcgttaatgcaggttctctattctcctcaattaatttcaggtccttaattgtgcatgacatatgaaacataaagggtgtttatttgctaatcaccagcattaattaattcaaagacttacctgagattctgtttgcgcaataaaaattaaaaagattactcagtaatacattgggagaggtgtaactggggcattaaaatacgaatgtgtgtctaattttcaaacatcataagtattttgaaagcacttatacataatcaattaatatatgttgttaactaaattcatatgaataatatgtgatataaattagtgttttgtattaatttcaagacaattagaaagagaatgtcaccatcactcttttgattcaatcaacagtccttagactggttccttgtaatgaatttaatgggttagtaaaagctgtgttatttgaaattatgtaattttgtttttttaatattttgctcaaatacttttcttattagtgtaaatgactgaagtattatgtaaattttaatactgattatctaaggtatatcattaaaacaaattatgagctgtgatcttgggcaaggtactcaaactgaaagatgttttccttatctgaaaatttagataataataattacctcatagtctgttaagaaaagcacatgtgataatatattttaatgtacaatatgtctggcacatattaaggtctaaaaaggataactgttactgttataccaataaatataataattttgataaatataatagtaatttaaatatattttttccaacatttattttaagttcaggggtacatgtgcaggatgtgcaggtttgttacataggtaaatgtgtgccatggtggtttgctgcacagatcatcccatcacctagttattaagcccagcatctgttagctattcttcctgatgctctccctcctcccatcccctacctccgacaggccccagtgtgtgttgttcccctccatgtgtccaagagttctcatcattcatctcccacctataatgagaactataaactcataattcagctcccacctataaatgagaacatatgatatttggttttctgttcctgtgttaatttgctaaggatggcctccagctccatccatgtccctgcaaagaacatgatcttattccttttcatggctacataatgcaccacattttctttatttagtctaccattgatgggcatttgggttgattccatgtctttgctattgtgaatagtgctgcaatgaacatatgcatgcatatgtcttttataatagagtaatttatattcttttggttatatacccagtaatgagattgctgggtcaaacagtatttctgtctctaggtctctgaggaattgccacactgtcttccacaatggttgaactagtttacactcccaccaacacaacctctccagcatctgttgttttttcactttttaatgataaccattcttactggtgtgagatggtatctcattacggttttggtttgcatttctctaatgatcagtgatattgagctttttttcatatgtttcatggccacatgtatgttttcttttgagaagtatgtgttcatgtcctttgcccattttttaatgggttttttcttgtaaatttaagttccttatagatgctgaattgtagatctttgtcagacgcatagattgaaaaattttctcccattctgtgggttgtctttttactgtgttggtagtttcttttgctgtgtagaagctctttactttaattagatcccatttgtcaatttttgcttttgttgcaattgtttttggcctcttcatcatgaaatctttgcccatgcctatgtcctgaatggtattgcctaggttttcttctagggtctttatagttttgggttttacatttaagtgtttaatccaacttgagttgatttttgtatatggtgtaaggaagaggtccagtttcaatcttctgcatatggctagccagttctcccagcaccatttattaaagagggaatcctttccccattgcttgtttttgtcagatttgttgaatatcagatgctagtaggtgtgtggtcttatttctgggttctgtattctgttccattggtctatatgtctgttcttgtaccagtaccatgctgttttagttactgtagccctgtagtatagtttgaagttgggtaatgtgatgccttcagctttgttctttttgcttaggattgccttggctcttcgagctctttttttggttccatgtgaattttaaaatagttttttaaaaattctttgaagaatgtcaatggtagtttaataagaatagcattaaatctataaattgctttgggtagtatggccattttcatgatattgattcttcctatccatgagtatggaatgtttttcactttgtttgtgtcatctctgatttctttgaagagtgatttgcagttttccttgaagaggttcttcacttaccttgttagctatattcctaggtattttattctatttgtggccaattgtgaatgggagatcatttgtgggtaatttaaatttttaaaatcaaatattttatcactcattatgcattattcttctctgggatagatagagatttcccagaactccgataagctttattttaacctatttacctctgattaatctgtttcacctcccggttgttactgtagtaactggggttattaatagcctcagagctaccaagacttctctgtaaaactgattatctttttcaggatagcatcctctaaatggttatgcaagatttatggttaagaatggaagtagctgattaaataattcaatgagctttactcaactatctacttttcacagcctctattttgtcccctgtggaagcacataacagggcttagctttggtgttgtagctctctgtcagaatacgcaattagtaggtctcatatataaaatttcatttcatcttaatattaatcccaccaaatggaagctatctaaactttaaagttaaaatgactgaggctaacagagaatatgtgatttgttgagggtcacaaacttaacgaattctccaactacgggacaaatgcatttttctcaaaatctgttaccttttatattatatcccagtgtctcatagtgccaagacaaggaaaaaatgaacaattcttagacaattatcttcttttccagggaatatctttccattttctttttcccatccctctcctaccctccccagctacagtcaaacctcaaatataagaaccagagaatttaaataaatgtcacaagaagaaacatcctgaatcgtgttcttcttctggttcctgaaacttccaaacatatcttcagcgttatcacaaagttcagtgatacttaggaataacctagtgctggacaccaagtagatgaccaatgaataatttttgtatttttagtagagacggggtttcacgatgttggccagtctggtctcgaactcctgacctcaggtgatccacccgccttggcctcccaaagtgctgggattacaggcatgagccaccgcacccggcccagaaacagatttcttatctgaaatatcagaaggcagaaaacaacaagagggaaaaaaggctgctaacttaacgcatggggaagcagggtgtgggcaggaaatgcagtgtaagagaggagatttgtacagggcgatggaagagacaatggagagaagacaatctgagcagaagctgtgaggagtagatagatgctggggaaagggactgctaattatggtgttattttaaaactagctttgtgtttaaaattctcattgcaacaccctcagagacctccactgcactgcaaaaatcttggatttatattttgtttatcttctggtgtaaaactgagctgaagcacactgattctactagaagaagtcaatgtcctaggaagacattgacagctgtagggatgttaactgggtcatcttcaccagtaggtggggacattgcactttaaaaattcaagggagctgctgctttcccttctctcctggccccttggcaggtctagatttgagggatcagcatttcttgagggtggtaacccagccactcttttttcccttactcttccttccatgtgttcaaaatatgatgcaatctgagatgtggttatgggtgtttgagaagcaaagaagcatgactggagcaggagttaaagtctgcttttgtttgagaactgaagagctcagtcttttacacgctttcacagataagagattggtactataaaattacatgcttaaaacaaacttcgctgctgtcattctaatgcaagccactatcctttttcacattgagcatcctgccaccatctgcagcattcttgatatttcagtaagaattaaattttattttgcaatcagtattttaaatttatcaggatacctgtatatagtttgaggattaaacaataaagatgtattttaatgaaaacaagagcccttcatgccattcctttcctccactagcattatccccaggtcaatgacttttaatggtaatatgtgtatctttgtgtatgtggggtattaatttagacatcagttatctaattatctgaaagcagataatttagaccaccaacaattttatgtctctggcatccttcttgcaattttattatattactatgtttagttcctctgtaggtaatccctgtatttaaaaaaaaaacaaagaaaacctacacctaagtatattgtatttaaactgtaaaaaaagttgaaatacataaatactgcttagaaaagcaaagtgggatgggaaaagtacaagttattacattttagtatatttcttaaaaatgaatataacaggtagatatttgttagtatgcattacaaaatttgggcaacatagttatgaagtatatttggatatttttcaatacatatattacacaaaggaagaaataaagtactgctcaaatcaatggattaaataacctagttgaaatattggaaagtagatgaacagtaattcacagaagaaactcaaatggaaaacagcatatgcaaagatggccaactttctctataatatttgacacagtaatattatgtcatttcagtttaaataaaattatacattgataaaaatgtgaaatcacgtctttgaggggttactaagaaactgtctagaagcattgttctagaagctgatgtggttttggaagatcaagtgtgaatgtccaaaggcacttctgttgaataaaacgccaagtggaggaattgaagatccctgattgtggaagtatccaactgtttagaactcaactgaaatcctgaatgatagttctctacatgtagcaggaggagcaagtgactcatggaaataacgggtttatttaaataaagatagcctttatgtggacatcaaattcatcaatgaatgtatccatttatttgtcaaataattatttagctcctactaagtgctacatgctattccagataacctagtcaaaaaggcaaatgtgtccctacctttatgagctttaattctagcaggaactaaaaaaagtcacataataaacagacataaaatgcagtgttaggttgtgattcttgctatgaagctacaaaagaggaaagctgagtaagggaataaagaaacaaagtgcttatcagtagtgaacttccatgcaggccatgacaggctcatttcaaaagaagcagaaatatttttattattgtttccttgggttattagtgtcacatgtaagaatagtgcactagatttactaccacagatttttgtacttatacgttattttgaacaaaataacaacgtctagatagttcctttcctcctgcaagaactaagtgtatgtaagtcctctcttttgtaatctagtttatttttttcacatgtgaggatcccagatactattaggatgccttcattgctaattggatcttggaaaatatactttcttgctttacaaaatatatttccttttaagcctcagagtaaattttgaaatgatctacccatggattagtcctctgattttaactagtatcattattctagctgtaaaggacatctattcaaactgtgtacaggtaagattatccagggggtatagtttagagcacccatataattttcaatagattatgtgattttacaagaatctatcaagttaatgtttcaagaatattgataattacttttagacgttttgctgaaaaaatacaaatagacagggagtccatagtaatagggtgggtctaaagttatgtagtctgagtgaggacatgggatgttaagtccagagacaggccatatgcagacagccagaacaatgtctcaaaatctacaaatggctgggcctggatcagtaattcttatgtgaaggatgccagaaatgagcaacgtaaaccttaacagagtctgaaaacacatctcaaggtagaggttagaatgaatccacctgccatcccagcctgatacacatgctagaatgggttatagaaatgggctaacaggaaaaaagtcattgaaatcatggaaaagaccgaaatgaaaaatgtgagataatataaaggtccatatatgttatttatttcagtaaaatgcaaatagacttgacttgtgatcaaaagacagagattgacaaattgaatgcaaaaatacaaattcagattatactgtttacaagacatatgtctaaagcataaaagtcatttcagagattgagtgtaaaagacagaaaggatatatcatgcaaatactaattttgaaaaatgatatcaatttattaatgtaaaaaacaaattttaaggaaaaaaggcattgtagatttttcttcatctctttattttgagcctgtgtgtcattgcatgtgagatgagtctcttgaagacagcataccaatacatcttggttctttatccagcttgtcactctgtgtcttttaattggggtatttagcccatttacatttaaggttagtattgatatgtgtggatttactcctgtcatcatgatgttagctggttaatttgcagacttgtttatgtggttgctttatagtgtttttgtagtggctggtaacagtctttccttttcatatttagtgcttccttcagaagctcttgtaaggtaggtttggtggtaatgaatttgctcagcatttgcctgtctgaaaaggatcttatttctccttcaatatgaggcttcatttggccaattatgaaactctgagttggaatttcttttctttatgaatattgaatattggcctccaatctcttctgcttgtagggttttagctgagaggtctgctgttagtctgatggacttccctttgtaggtgacctgatctttctctctagttgtttttattttttattttttaacattttttctttcattttgaccttggggaagctgataattgtgtgtcttggggataaaagtcttgtgaagtatcttattggggttctctacatttcctgaatttgaatgttggcctctctagctagattggggaagttctcatggatgatatcctgaactatgttttccaagttggttccattctctccatctctttcagggacaccaatcagtcatagatgtggtgtctttacataaccccatatttctcagaggttttgttcatcattggggaagacagtgtggagattcttcaaagacctaaagacagaaataccattcaacccagcaatcttattactgggtatatacccaaaggaatataaatctttctgttataaaggcacatgcatgtatatgttcattgcagcatattcacaatagcaaagacatggaatcaacctaaatgcccatcaatgatagactagataaataaaatgtggtacatatacaccatggaatactatgcagccataaagaaacaaaatcatgtcctttgcagagacatggatgaagctgaaagtcattatccctagcaaactaatgggggaacagaaaactgaatactgtatgtcctcacttataaataggagctaaattatgagaacacatgaattcataaaggaaaacaacacacactggggcctatcagagggtggagagtgggaagagggagaggatcaggaaaaataactaataagtactaggcttaataactgtttgacaaaataatctgtacaacaaacctccatgacacaggttacctatgtaacaaaactgcacatgtaccccgaacttaaaataatagttaagaaaagaaaacaggccgggcacggtggctcacgcctgtaatcccagcactttgggaggccgagacgggcggatcacgaggtcaggagatcgagactatcctggctgacacagtgaaaccccgtctctactaaaaatacaaaaaattagccgggcatggtggtgcccgcctgtagtcccagctactcgggaggctgaggcaggagaatggcgtgaacccgggaggcggagcttgcagtgagccgagatcgcgccactgcgctccagcctgggcgacagagcgaaactccgtctcaaaaaaaaaaaaaaaaaaaaaaagaaaacaaacaaacaaaaagcaaattaaaaataaaagctatggttgaatcaatgatgacattgaggaataaaacaagcattaggatcatgacattagcacaaagccattcatgagggatctgcccccatggtctaaacatctcccattaggccctgcctccaacattggggatcaaatttcaacatgagatttggagtggacaaatatccaaactgtggatgggaatgcatgtggaagaaatacttaatacaattgcatttaaaaagtagagagggtaaaatatgctaatggtactagagatacggactgtatccttcactcaaagtggtaaaacatcaataccagtagactgtgataagttatatgtatatattgtaataagtacaaccaccaccaagaaagctatatgaagcaatgtactaaaaaggattaaaaagtatgagtgtagatacaaaagttcttcctgagaacttcaaataagatagatatgcatatggtgagtagggctgaagtcttgacttctatgcctgaaagtaggcattattggctgggaatttaattcctaagtgggaaagaaaccaaaagtgctctatggaggaaagacagccaaattttgactttctgcttctggctaggagctgaggttgggctccccatgattttaaaggaggttgaggagaatgttttcaaacacttgtatgctatagatataaggaagtgagaagacacagaataactttctcaaaaggaactgaagcaaataaaaaacaactgtcctgagaagattgttattgttccagatattacaacaggacaataaatctgaatgatcactgaagaactgggattttgattggaagcctgatgggctgaggtggagtggctaaataaaacctctggacagggacagtggagtacagaaaagaagaggagggaggagagtaaaagagatgggcaatgctatggtttgaatgtttattttctctgaaactcatattgaaacttaatccccatagtaatagtattaagagggctgtaaatccaactatggtatttgagaggtggcacctttgggaagtaattaggattagatgaggtcttgagggtggggcattgagaggagaaacagagaccttgagccatacccctttgccctcttgtcacatgatgctctgcacctcatcagaactcagcagagggcccaccaataagaagactctcaccagatgctggcaccatgctctgggacttctcatcctccagaatcataagagatacattttgtttcttcataaattacccaatttttggcattctgttacaagcaacaagaaacagactaaggcagaaaattggtactaaaaagttgggctgttgctaataacaaatatctgaaaatgtggaagcagctgtggaactgggtaatgggtagaggttaaaagaactcaaaaaggcaggcgagaaaaagcctgtattgccttaaatgtcaattctggtgataaagggtgattttggtgagggcttagaagaagtcaagaagactaggaaaagtctggaactcctttgtgatgatttgagtggtcaggaccagaatgtcaatagaaatatggacagtaagggctgttctgctgaggtctcaggtctgaggaacaaggaattggaaactggagtaaaggccatccttgtaataaatgggtgaaaaacttggctctgaattgtgtctatatctgatggttttattaggctatatggcagaagaaatatctaagcagcaaagcagtcaggcagctgcatggctacttttaactgcttacattaaagctgtgagaggtaaaaaataacttaaaggtggaatttataattaaaagggaagctaagtggaaagattaggaaattttgcagcctggccctgaaagagcattttcaacagaggaaaccaagggtgtgtctgaaggaatgattgttaaggagggactgattgataaggagaattgtatgaatagaataaagccagaagctattcatcaagacaatgggagacaaacactgaatgcactttagagatcttcaagtctacccctgccatcacaggcccagagctctaggaggaaagaatggtttcaggagacaggcctggggtgtcctccatgggcttgctgcccaatgccacctcagggcagtgcttccctcatcctggttgctccagccatagctcaagtggccccagatgtgactcatattgtagctgcagaaggcacaagcagtaagccttggcaatgtccacatgcatgtggtgctatttctgcaggtcttcagaatgcaagactagtgggaaggcatagaaatctccacctagatttcaaaggatgtatcagactgcctgggaacccaaggagaaaactgccacaggggcagggccaccactgtggggaaaagcaagagggatcagattgttactgtgtctgtgtagaaagaagtagacataggagactccattttgttctgcactaagaaaaattcttctgccttgagatgctgttaatctatgaccttacccccaacaccgtgctctctgaaacatgtgctgtgtcgaactcagggttaaatggattaagggttgtgcaagatgtgctttgttaaacagatgcttgaaggcagcatgctccttaagagtcatcaccactccctaatctcaagtacccagggacacaaacactgcggaaggctgcagggacctctgcctaggaaagccaggtattgtccaaggtttctccccatgggatagtctgaaatatggcctcgtgggaagggaaagacctgaccgtcccccagcccgacacccgtaaagggtctgtgctgaggaggattagtataagaggaagacatgcctcttgcagttgagacaagaggaaggcatctgtctcctgcccatccctgggcaatggaatgtctcggtataaaacccgattgtacgttccatctactgagatagggaaaaaccgccttaagactggaggtgagacatgcaggcagcaatactgctttgtaaagcattgagatgtttatgtgtatgcatatctagagcacagcacttgattctttaccttgtctatgatgcaaagacctttgttcacgtgtttgtctgctgaccctctccccactattgtcttgtgaccctgacacatccccctctctgagaaacacccacgaatgatcaataaatatgaagggaactcagaagccggcgggatcctccatatgctgaacgctggtcccctgggtccccttatttctttctctatactttgtctctgtgtctttttcttttccaagtctctcgttccacctaacgagaaacacccacaggtgtggaggggcgacccaccccttcaaccaccaagagcctctgctagggcaatgctgagaggaactgtggggttggaactgctacagggagtcctccccagggaaatatctagtggtgctgtgacagtgggactgccaccaagactccaaaactgtagagctaccagcatgcagtcccagcttcgaaaacccaaggcacctgactccaacccatgagaacagccatatatgggctgcaaccagcaaagccatgagggcagggttgcctgaggtcttgggggcccaacttctgcccctgtgtgctcaggatgaggaacatggagtcaaaagacattatttccagctttaaaatttaatgtctttccctgttgagtttcagacttccttgaggcctgttacttctttcttctggcccatttctcctgtcccagcattgtatcttggaggtagataattggctttagtatctcaggctcacagataaggactttggacttttggacttttgagttggtactagagaaagttaagactttggggctctggagataaaatgaatgtatttgaatgtgagaagaatatgagttttgaggctgcaggggtgaaatgctatggtttgaaagtttgctcctctaaatcttatgtagaaacttaatccctattgtaacagtataaaagggtaagaaaacagaccatgatattttaggggtgggagatgtgagaagtaattagtattagatgaggtcatgaggatggggtgatgggttactaagggtttgataagaggagaaagagatacttgaggtagccctctcagcctgcttgctatgtgatgccttgcaccacaatgggactctgcagagggtccccactagcaaggaggctctcaccagatgctggcaccatgctcttggacttcccagcctccagaaataaattttgattctttataaattacccagtttcaggtattctattgcaatcatcaggaaattaattaacacagcaaaatcgacatctagaatacaaaataatcccagcactttgggaggccgaggcaggcggattacctgagttcaggagtttgagaccagcctggccaacatggggaaaccctgtctctactaaaaatacaaaaattagccgggtgtggtggtacatgcctgtaatcccagctactcaggaggctgaggcaggagaatcgcttcaacccaggagatggaagttgcagagtgagccaagattgtgccactgcactccagcctgggcaatggagtaagactctgtctcaaaaaaaataataataatatacagtaattggagatgaaattaatttaagtgttctggtatatactatgtaagtatatgaagtataaataagtagagtgcagatgacaccaataacaatgacttcattgctattctgtctcagtgaagaaggggtcctgtaggtatgattaattattctcttaggtgtgtcttctcaatgccagcaaagctaggtgtgggtgaaaaaaataccacctagtcttttttgttaagtgactataaatatcatcagatccctgtgcttccctgtctctatccccagggattcaatgacatttatacacttggttcccaggtgagattttaattaataaactaatctcatgactgttagcaattataattagatattctgtcaagttcctaattctcacatcttcaagtcctgtaatttggtatgaaggcactgcgaatttggactttgagctaacaagatttagacaggatattggccttgatctgaggctgtaatggaatgagactttggggggcccttgagaagggattaatgtattttacatttgagagggacatgaattacaggtggccagagggctgaagaggtgagaaggaaagcagaattctaagatggcccccaggaatatctatcaccccctgttgtacataccttataaaattattttcctttaaatgtgggtggaacctaccgagaccagcttcgtcagggagaccctaacccagcagcgctagaggaattaaagacacacacacagaaatgtagaggtgtgaagtgggaaatcagggatctcacagccttcagagctgagagccctgaacagagatttactcacatatttattaatagcaaaccagtcattagcattgtttctatagatattaaattaactaaaagtattcctatgggaaacgaagggatgggctgaattaattgcagcaggaacatgctcttaagacatagattgctcatgcttttgtttgtggcttaagaatgcctttaagtggttttctgccttgggcaggccaggtgttccttgccctcattcccgtaaacccacaaccttccagcttgggcgttaaggccattatggacatgttacagtgctgcagagattttatttatggccagtttatggccataaactgggccataaatttggggccagtttatggccagattttggggggcttgctcccaatagtaaccagtaaatttaatggtatgatcactactgtgattgggttatgttttgactgcaattagccttatgaaaaggaaattattgtaggtgagcatgaactaattaggtgagcccttgaaagggactgaacttttcttgaagagggagattaaacatgagaaagactctgtattactgactttgaagatgtagagggccatgtggcaaggaactgagagtggtcactgggagctgatactgatccctggctgatagccggcttgaaaacatggacctcagtcatacgtggaaataaattctgtcaacaggcagtgagcttggaagaggactccatattcaaatgagaattataaggtcagcttgtgacttcagtcttgtgagatcctaagcagagagcccagttgagctttgcctagacttctgacctagaaaactgagataataaatgggtgttgttttaagctgcaaagtttctactaatttgttatgacagtggctagaaaattaatacaatatgctttgtttatttaaattttacatactgcaccataagcacctttgacataaacagaatgcttaaaattgatatacctttcacatattaattctttactttttcttagtatagtctaagaatactttcctgtacggtttctttctttgttttgttatttaaactcatctcaccactttttaataaaataaatatttactttttttttctatatttttgttgatggctttcatgaaacttcggttcttgtcttcttagtttaaaagaatttaaacaacagacacacagcaaaggagatacaacatagagcaatttcttgcaaaggagaaaggatactctgaaagttaggtgcagaatcaacagtacaccccaagagacaattcagggcaggttgcttgtgcgggtgagacagtgttgaatgttactggggaaactccctttatgggagtcttacatgattattcataagggggtgggaagatgtgttactagcaagcatgttctgggtggttcctcctcagttctgagttccttctcatttaaacttttaatctgcctcagtataatctctgtatgtgtgtatgtatgggctctttttactatcccactaactcactaattgacccaacactatttttagtaatttttcctattccactggattaaaagtttgctttattatgcactacattcttaatttatccaacataaatgcaggataacttgttctatccttgaaagcagtcccagtatgatgttctttagagaggccagagcaaatttccccatactccatttcaaatacttcaaattatattgcaacctcttgaaaaatatcaaattaggattgtatttctaacaccaagaaaaatgatttaaaattcttttaaaatagcttcttgtcctaaaaatctcaccataatttcctcatcactatgctgctttctctttcattccatattggtgtcatgacaatcaagtatatttcaaaaaacttgtttccggaccccttacatcccactgagttccattcctcattagctacagcccattaccctacaaatttggatagactccagaagagtagagtgggcccttatgtactttgaagaagtgaagaatataacctgtaacattgaaggcttcttagaaatatgtttgtctcccatcccaaaattttctcaaagggtttgcgacttcctagaaatgtaatacagtggtcctcccttatcgatggtttcactttccacagtttcagttactggtggtcaatcaatcacagtgtgaaaatataggtgtttagtacaataagatattttgagaagaggggagagagaaagagacagagaaagagagagagagatctcatttacataacttttattacagtatattgttataattgttctattttattattagttattgttgttaacctatgactgcacaatttgtaaattaaactatatcatatgtttgtatgtgtagaaaaacatagcatatacagagtttggtacatgccttcaggcatcctttggggtgccttgcaacatatctcccatggataagagggggctattgtaaacaaaattttcaatttcattaattgtggcataaattaggttctgtttatgtgcagccaatatcattccacagttgtcctttttttggggcactatgaacatgttttaattgtttagctttataatcatttgtaaacatctattagagtacctctccttatttttatcaatagttgtttttgtataccgctcttgaaagttagaaacattttgttaataaaactgtcttattactatttagattaaagcatcaccaaatccatgtattttgtctggaaaagtgacacaaattgccctgtccaagaaagtggtatcattgtttactaaacttctttctgtccttaagtaaatttctattcttttctgtggattgcacacatgactgctttgatattttgtatatttattgctcttttcaataattttttttctggaatggattcattgacctaatctgccagagagaattaatgaggccccacatcttctcattagttggagaagaaagtatttaatggtttaacttgaacgtgacttttgtgaatcttttttttttttttttttaaagcagaatcctgtatttggttacattctggtctagtgaccacttccttcaggtaaagcaagcttccctgtctggaacagccaggcatgtgataaaaaatttcctttgtggtcacttagttattattcctcttgtcttgagtgtctgggctgctattttcatgtatttacatccaaatgaagtctttctttccaactttttatagtatgttttgattcacaaaatattttagccttatctacaatataataatttctcacaaatgcaaagaatataggtttgtacagttttgaagtaatattggcaaaagagtatgaagcagagtgcccatatttaaatataactttcaacatgttagtctttctataggtgttttcaggataataaaaattaatttgattgatatagacttgggggcaatatatgagaaacaggctctgctctaaaggataggatgagaggtgggcagggaggatttgtatggtttgaattccaggcacacacgctaactgctaatttggcatcatccaccaggttgaatattttcatgaaattctgtcttacatctctgctaatcctaaaacaaagaatgaggatcatttcaggtgagtctaagtcaggagaaactattaaaattgttatattcttcatttaatttttttctatgattattttttcttctttttatactaattagaataggccaaactgctgcaacaaatagactaaaatgtgtattgtggctgaaatatagtagaagtttataactcactaatgtagcagaaggaggatattgaagatttgtgagtcacttttctccaggtggtgattcagaattccaagctcccatagtccaatatggtgcctttcattttttttcctgagaaaattaacacattttaatttttcctcaagaagggaggtacaagagtgatcaattgtgatctagaagattaaggcaagaaagttagtgaaatttgctacagtgtctactattatagttgtcattatgactgtaactaatatttgtttccctccttcacaagccattcttgattcccctcatcctctgaatttagtctagtttgtttttctgttttggtgacagagacaactattccagaagggtctatgttactatttactctgttcttgaattatgattgttttagtgtctactgacagacatgaccatgcatagaagcactaaaagactattgtattttcatctgggatagtagtctctgtcactaaaccagaagaacaacctagtttttagacctgttcaagcttggttccaaaggaaccacttctgctgcagatggattgtggttggtatccccaaacttacgactccatggatttatagctcttcgcatcatatggtcaatttaaggcacatggtcagtgtgctaagtgcctatcaggaagaaatgaacacttggtcatagttttagaactatgaaaggaaattaaatcttgggactccaactcattaagcctaagggaaaagttaatctgggaacggggttgcgaaaacccgcctccccctttttggttcctaaataagatggctacaaaatgaaaagctacatgcctccctcatattttgtccacaaggaaagtccttgtgagctgcaagatctttactctaaggtgtttctgttaaaattttaccatggcaatgtaaattggtagcttatctttacaggtgtagtcacgcccctgcccagaagacacaaatgcatatcttttttttttttctttttttttttttgagacggagtctcgctttgtcatgctggctggagtgcagtggcgcgatcttggctcactgcaacctccacctcccgggttcaagtgattctcctgcctcagcctcccaagtagctgagattacaggcatctgccaccatgcctggctaattttttttttttgtacttttagtagagacagggtttcaccatgttggccaggcctgtttcaaactcctgaccccaagtgatctgcctgcctcagcatccccaaatgctaggattacaggcatgagccaccgcgcccggccacaaacgcatatctaattgttccccttcccccgttttgtctatgtcatcttatgtaaaaaaaatgcagattaactgagccagacaaaggcatgaatgactatttttccttaccctcctcttacatgaaaattgtgtacttctcaatatccctaccctttccccttaaatttagagccctcaaaattatcttcggagaaaggtatagacctgtctcctgggtgcttattcttaactttggcaaataaacctcctaaaatgattgagacttgccatttttctcgattgacagaacacatgagttcatgcaaagttactgttggagaagttttcctgtggttgttttttggaacatgtaatatgaatgaagtgatcaagagtttgagctgtgacttacactttaggctataatagagtaattggtgcggttaagacttcatctctcctgggcagctttcttgagctttaggagactgactcacaatggagctgaggcttcttctgtcccttgctactgatctgtaagtaataaaactgcttcacataatttgtgtgtgagtgtgttctgtttcaccagactcagataaacaggtagccagtgcatggtggacataaacagtagctcagaatgcagtgggaagaagtatctggacctcttttcctggtggttggcatagtgatgatcttttctattctccatgcagtggaagtcctccctttcctcccttggtattggtaattagtaaacctgcttcataaactgtgattaatatactaaaatctctaatggaaaaggtagacaacatgcaagattagacagtttcagcagagatatgaaagctttaaggatgaatgaaatggaaataaaataaaaataaattaacaaaaataaagaatgcatttgacaagctcatcagcaaatgtggtacagccctgggaagaatcagtgagtttgaaatagatcaataaaaattacccagagtgaaacacaaagagagaaagagagtaaaagtacattaaaaaaataagcctggcacaatgtttcacatctgtaatctcagcactttgggaggctgaggtgggaggaatgcttgaacctaaagagcagcctgggcaacataaggagaccttgtctacaaagagagaaaaattaagtgggcaagcatggtgctggtattcccagctactcaagaggctaagacgggaggactgcctgagttgggggcgagggtgggggatgaagtgagctgtgatcgcaccactgcattccagcctgggcaacagagtgacaccctgtctcaaaacaaacaaacaaacaaacaaacaaacaaaggtgatgtaaccattcaatacagcactgcagctcttggatgctctgttttgtttttcccctgctcttcttttctctttgtatttcacattgggtaatttttattaggtatcttattgaattagtttgttaaaagataaacacattatttcggttggctttgcttttttaacattatattttgaaataattgtagattcaaagggagttaccaagatagaacaaaaagattctgtatagccttcatccagttttccccaattgtaacatcttacataactaaagtgcaatatcaaaaccaggaaattatcctgacatatatagtcaaacgattttcaacaggagtgccagggccattaaatgcggaaaggacagccttttcaacaatggtgctgggaaaactggaagtccacatacaaaagaatgaaactggactcttaccctacattatagacaaaatgaactcaaaatgaatcaaagacctaaatgtgaaaactaaaaccataaaactcttagaaaaaaaatagggaaaatcttcatgatatttgattaggcaatgatttcttggatataacaccgagggcataggcaagaaatgaaaaaaatatatataaattggactccatcaaaatttacaacttctaattgaggcatggaaaactaaataccatatgttttgatttgtaagtaggagctaagtgggtactaagctatgggtactcaaaggcatacagaatggtataaaggacaatggagagtaagaaattggggaggatgggaaggagggtgaaggataaaaaactacatattgagtacaatgcacactactcaggtaacaggttcactaaaattccaggcttcaccactatacaattcatccatataacaaaaaaccacttgtaacctaaaagctattgaattaaattatattaaaattaaaaaattattattgagcatctactatgtgttcaaactattttagatgctatatatttgccacttcatttaatccttggcattactctatggaatagataatattctcattttgcagttaaagaaactcatactcagagagattaacttggatttatgagcaatgttgacattataaagtagaggcaggaagaccagttaggatgcttttgcagaaattaacttgagtggaattgtcggtctgtgagaatagaaaatgaatcttttgggaagattctacaatgttattgtttttgcataagtgactttttcctctactccctcttttcacatgtaaaatgtagatttactgaggctaatcagactcacaagaatgtaaccacttgtgtcattgcctaccttccctccttttttttttttttttcctctctctttcccttcctgcttactctttctttttaaacattgaagttctcaaaaccctctttggaataagcattgatcacagatgctcctgtgattcgtgtttttcccaggtgcatcctgaaccttggcaaaataaacctctaattgattgagacctgcctcagtcacttttcggcttacaccaggatttctttctttttaaagcctgaatagaattccattgtgtatacatacattatctttacccattcatctgctgaatgacacaggttgatttcataccttgactattgtgcataatgctgcaatgaacatgggagtgtggatatattttcaacctactgatttaaaatcctttgtctgtatcctggaagtgggattgctacatcatatggcagttctattttaactttttgaagaaccttcataatgttttccctagtggccatactaatttacattcccaccaacagtgtgcaaatgttcccttatctccacgtccttgttaacacttgttattttttgtctttttgataatagtcatcctgaaaagcatggattgatatgtcattgaggtttaaattgaatatcttaagttttcctatttgaggatatgagtagtccccccaaaatattactactaatgttgcttttttgcatgaaccatgaccttgagctgagctggacacttgaattcttgagtacttggacatgagcttaaataggactgaaatattttttacatacctgaatattagttcttctctctactggtaagaacttgtagaagaagacattataaagatctcatagaaagatatttaaggtttgtctgggaatgaaggcacatgatgactacaaatctagaagctggggaagagttgtctctggaaatatcccaggcattactagggaaccagaagtagagacgaacagatatgttgcaaagagtgacatgtgtaggttagctctgggtgatgaaatcgtcagtggtccagctgaggtgatgcatggatgagattgactggaagaagaaacctgtagaaacagatcaggaaacaaagctccgttgtacacacgtccatagcaggcagcctgggttttcatcccagtcttcttctgttttcaagggccatttccatactgcatgagaagccatgagactggtgggctctggactcctgtgccagagatcactcaccttccccatttcccccaagtgtcccaaatgccttgtatcatctgattttctatcttcctgctaaagcttttcccatactcctagtccttcaccctgcggtatcctccaagtccttacctgacttccactatggagtctccccatggttacttgcttgaaggaggcactgtttgagcacagcctctgaatgctacagactctctcttcagattttctaaattgtcattttaaagagataactgtttaaagagaaaaggcctaccttatatgtgtcatgaaaaattcatgtaaccggttacctaaaagttgatataagagaaatatgtaagtagcttcacaaggttttgaaaaatttggagataattacttgataaatttttattaaaggaaaatgatattctggggctgtatttctgttaccactggcattaaggaggccacagaacctttctgactctacagtgtttcttgattctggaagtaattgcaggacagagtcctggataacccttctggtgacaggatgactcctgtgtttacattcaactgcactgaccaagcacagattctaagagatgctgaccagggaagatgatttctcccttgattccacaaagaaggagtccacaacctttttctgccctgaaagaagagacaatgtgccctggggagtctccctagtgtaaccttgacccgtaataacagcagtgtctttatcccatcttcccacatggggtgtgtgtggtctcatcctaagcgctctgtccccatcagaggccgggcaggtgatttgggtgaggcattcagaatcaggatgcttgtctgagttgccttcctctggccaggccaatagtggctgccctgagtaatggagcagggataggaacattgcaaagaactgtagagaaggctggatcagggggacacaactggcagaagccccaaaccaaagccttttagattaggtgttttttttttgttgttgttttgttttgagacagagttttgttcttgtcccccaggctggagtgcaatggagtgcaatggtgcgaactcagctcactgcaacctctgcctcctgggttcaagcgattcgcctgcctcagcctactgagtaattgagattacaggcatgcaccaccacactcggctaattttttttatttttggtagagacgggtttcaccatgttggccaggctggtctcaaattcctgacctcaagtgatctgcctgccttggcctcctgaagcgctagaaaattacaggggtgagccactgcgcctggcctcagatgaggttttagccagtcagaaaatggctctaagctgacactttcgttgctagttgaaaagtctgtgtggccaggtgtggtggctcacacctataatcccagtgctttgggaggccgaggtgggaggattgcttgaggccaggacattgaaaccaacctgggcaacatagcaaaaccctatttctataaaaatttttttaaaaattagacagaatggcggtgtgtgcctgtactcccagctacttgggaggctcagacaggaggatcacttgagcctaagaggttgaggctgcagtgtgccatgatcatgccagtgtactccagcctaggtgatagagccagaccctgtccctaaaaaagaaaagaaaagaaaaaaggaaaataaaaaaaaaggaaaagaaaagaaaaaagtctgtttgaagaggcccatgagactggggagtccctaggtttgacgtagactttgcctcacagccccagaataaacctgagggaagtttctccctttgaacaggaagaaggggtgggccagaggcctctattccgagggacgctgaggtggggactgagaggacattgagggcatcttcaggtccctctctgcctattctttcttgcccccagttccgttctaggtctgagtttgatgttcctcctttatgcttccatcgcaccagtggagaccctccttagactgggggttaccctgatcctgagtacaccactgctgctagaagcccagtaacaacgttcccagtctcaggtgatctaaatctatgcacagaataatacagaatattagagtggctcaatgctttcatgtgccactattgcaaacctcttgctaccgtctcttccctgtttctttttacctggtaaacatattctgcttttagatgctctctatcttctactttactaatatacagggaagagtgggaggaagggagacaagaagagaggtggagatatttattgtcttggttaggattaccagtaatgtttgtcaggcattgttttaattgctttataaccattagtactatccctagccatgggcaacgtaagcctgataagtaagaaatttatttataaaaacacattggtacctctgccattttggatttgatgtttagggctggcccaatatgacctgtaactctaaacatttgctccatcattaatacgattcagcccccaggaaattcttcttcacagcttttgttctctatcttcaaaactaaatgtgactgtgtctgaatactgtaaaatttgtgtattgtgcctttgctcatatcagatgcacctgtttcatggttcagggaggatttaagcagctgaagaacttacaagagaaaagtcaacaaatactttcactcgaagagcatgaatgcaataccttcttgcataataaagaatcacttgccagtagggctgggtgtcaacttttttttttcttgttcctcctattagcttgatagttacacataacagtggaggaggcttttgtaatattaaactagtcatattaatgttaaatttgtatatgtgaagatctagatgtaaaatgcataaaacatgatccacattttgcaaagagaagcctgggggtgaaaaggagttcagtaatttgttgactctcataaagcacattagtggtagaactgcaactcaccatcatttccttctaagaactttgctcttctcaccaaaacttaaggctcctcagagtgtctaatagaagtgaacatttctgtgacaattttctgttccctgaaatatgatcctcacttaatttgccctactaaaactcccaagtataagaacaataggttgtaagatgtctactcttgaatcacatttgtcttttgcttcttaaaacccctaagccattcaatcttcagctattcagaaatcttcacctcaaatgttcatctagtgcaatttgaagaagaaacagtgccaggcattggagtgagaatcttcacagaaaaatgtctgcccagaggcagatgaggtccttcagctccagtgctgattggttcctttcctagggactccccaatcctaccacacatggaaacatccagaggtttttattctttccggcaggtacataagatccattaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccagtaagtgcagggcagctgctctcgagagccaccactgtgggaacaggctctccttgggttggagtatgggggatggtgatctccatgatctcagaacacagtcttttatcaccatttattctttttgggaaatagagctatgttgcatttttatttccaccttataatgggtgaggtgaggataatccaaccccaatcccacaggtttaagcctgaaggaggagagaggaaagaggagacaaagtgtgcattcactacctgtgacaggacaaaatgaccatggcactccacggttatgcatttccccaaagatatgcatttccccaaagacacagtaggatttttctgcactgggaaaatgtaaggcagcaatggtgtctgtagtctctgtattggaggtaaaggagtctatactactgactcgagtggagagtttgtggaggcaaactcttagtactgagggaaggtgactggatgaccacagacagggagtcttactttgggtttcactgatttatgggcaaaaggtgacttgagtgggattcagggacctgagttgatggtggactgaatttagtatgataggaaggaggaagtaaagaagggaaataatacatattgagaaaccactccattcagacacaggacagtactttctataaatcctctctcactcctcctaacatcctatgtgtaggtatcatgattttccttttatgtaattatacttgtgatatggatattctgttaagtaacctgcccaagctggtgattgactcagtttaattggaccctatagaattcaaaagcttgggctctttccatgaataaatgtttccttctaggactccggaggtgtaggtcctttctaacacagaagtgagtgaacctcacagggcacttgggcgggtatagcagaaagagagtaaatccaggcatgggtttacttggtctcttgcccagggaccaagagaatacttacatcaggatgagaacaagcttaattcctgaacctttctcgttattcccttgaactctcaaatttatgtggataactctgtctctgagattcccaagagctccatggaaaatgggatttcatacgagaacgccctgatctaagagcagaggtcaatgtcgaatcggtccgactgccctcttcacttggttcacaggctcaggcagggactgggctttccctcttacctccctaaaggaaggcagattcccgaggccctcagagagggcgggcagggctggggcagagatgtctcgaggatcccaggtccggagcacgaggcacgggcccagccaagaactcaatttcgcgtggacgggtttcgcagctgctggccgggtcagggcagcggctgaagggtgcggtccggctgggggctggggctagggccgtgctggggcctgactgacccgccgtgattctccgcagaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaaggtgagcgtcgtcgtccttccgcggggctcacccttggccggggcccgagtctcttgcgcacggaggggcgaggacggcgcggcctcaaggaccgagccctgacccatcccagggtacaggaaggtagcggggatttggaggctggggtagtatcggaggggcggggatctagggcagagcagggggatgcacaaaagcatcccttagttccctgcagggttgggttaggctgcccagtgtgtccccagcctccccgtccatcggccttgtcctctgctctgcatgttcttgccttgtgccttatgcgtttgcctcctcgtgccttaccttcgctaagcagttctttctgcccgaatgcccgccctcttcccctgcccgtccgccccactagcactgccccacccagcaaggcccacttgcacagctcgcgccgcaggaagcttcaggcttggcctggtggagttagggctgctccacaactgcgcgcagggcatccagcaattacagttgtgaaataagatattttaacttttggcttcaaattattattcatcgtaattctgttttcttaaacggctctcattcatggcggagctctttgaggtgagagtgttttaatcattgcatgcctagtacctgactcgtggaccggcatgtggtatgagctcaatgatcttctgttaaattaatgaataaatgtactcagctgcccatccacttaggctcaagggaaagcagaggataaatagagccttaaagatggactttatcaattattttctattattttgcttaatgctgtaaactcttattgacttggatcttagtaaggtttgtgaatgcagtctggggaaaaaggtgtttgctgaaaataaaaacaacgcttgaatggtgttataaggcagttttaatttcttagaaaagctgaacaaatggcacaatgaaaagagcagaagctttggaatacatagattgaagccactaaattattgaataaaaatagtttcaggttgcttttggagtagattttctccctccccccatcactatccacttcgggcataaacattctgaacgtcaattttacccacttagtgagcacttatttctagacaattgccttagcaaacaccatctaagttatgtcatttaatagcacagttacctgtgcattagagattagcattgccactttatatatcgtaatattggtacatgataaacactttaagtaatcaacccacagttatgcactaggacctgaagcctcccccaaatacacagcattcttttatgttcttcaatactcgtctacacagcctaagggaagtaaagccttgttaaagccaattttgacaagaagcagcaatgggtctattcctgcctgttttcactgttaatgggacaaaatgatactttcaaggcattgaaaattcactgattaatcaatccctagtctgaccccagtgttatctatgcaggttcacaaaacttccttgccttcttctgacccacatcctaatgctgtcaattatttatatttttgccatttcaagtctatttctataaaagttattctatcatttttctcatgaatttgtgccctctatttttactttcagtcttttaagatgaacaaatcttgtaagtccccacatagctgactgttatttcagtcagactccaggaaggagggcctaaagaaaagttcaagtccaagcagaaaccaagattccttccagacaatggctcatgagtgccatttaattggggtgctacctgctgacctcagcaaatcccagctatatgtatatgtttgcattacaggcacattcacccaggccaacctctgcatggatctcagaatatttcctatggagaacgtacatgataatgtctgatttcagaacaagaaagtaattctcaatagcaaggggatggagtagggtaggcagctagtaattacactatcttgagggttaaaaggaaattaagaaaaagcaggaaaatgagagaacatattaccaagtaaataaagcatacattaaatatttactataattttacactaaagaaataaaggaaatgcagtaaaatggccagagaggtaaaggttaagatgtataaaatatgcagggaaaggtgtgtcatttttgaccatgagcagcgctctgagaagataaaggaattgagttatgggcaaacatgatgtttgatcagtgttagtttttttcaaggcctgcctacttttccttcaaatattacaaacttttgaaataacattcaattttttggtctctgttactagattgcaagttctataaaggcaggaaccagggtttgttgtttatttttggattctcagtgattgtcaaatttatatttgttgaaggaaccttaatccaagacttggactccaggtatctttctattctggttccaaggagggaccttcctcacagcaggcgtgctgtgtggtctcacatctcactcctatatctttccctgtctgttactgccctcagtggagcccacagtgaccatctccccatccaggacagaggccctcaaccaccacaacctgctggtctgctcagtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgtaaggggaaactggtttccttttactgtgggccccacaagacaaagggcagagctcccgctgatccttcccatcccatctcttgtccctgacatcactactgagctgggaatcacaggagactagagcacctgttgcccatggcaagcacatcagatgaatcctgatctctttgtctttccagatactagggagatcactttccacatttgtgttagtccattcttgtactgctacaaagaaatctctgagactgagtaatttataaagaaaagaggtttaattggctcttctcactccactataaagaaatacctgagaatgggtaatttataaagagaagaggtttaattggcttatgattctgaggctgtaggggaagcatagtggcttctgcttatggggagacatatggaagctcctaatcatggcagaaggaaaagagggagtgaggtgtctcacagggcaggggcaggagcatgagagagagggggttggtgctacgcagttttacataaccagatctatgagaactcactattgtaatgacagtactaagggagatggtgacaagaatctggtctaatgatccagtcacctcccaccaggctctacctccaacattgttaattacaattgaacatgaaatttgggtggggccacagaatcaaaccatatcaacactactaaagccccagaaccagctctgacagctatgagagactgacttagggctggtgactggggccttagggtttaaggttatggatgaagtcctgaggggcaggggtgtgcttcttcctctccctcacccacctattgtgtccaagacctactggctggtctttctcttccctagggtggtcagactggagaactagtgtcccctgacatctccacctcctgtaccaaggacattatggggtgtggggacaaacactcacactcagttctgctccttaggggctcagtctgaatctgcccagagcaagatgctgagtggcattggaggcttcgtgctggggctgatcttcctcgggctgggccttatcatccgtcacaggggtcagaaaggtgaggaaccccaagggaaaatggggaagatgagctgtgacccagaccctctattcagagaggttctgtctctagatgtagctctttcctccttaccctgagaggaagtgcgaggagacaggacaagattggaggaggcattggaatctgattttactgggtgaatggtagcgctgccagagctgactgatagagcttattccagggcgtccttaccgttcatcatcgtctcactggctcctttctaaaagcttcctccattatgagggtcagagcctcggcctccttgtcttctagtgacaatttcctttgttttgggggattttaacttagggtgcttaaggacttaaagaacatgggagggaagaggatataaccccaattaaactacatgtgtcattttcctttggggtaagatagtggttgtttgtttaacaagacctttctctgtataacttccttttgtaggacctcgagggcctccaccagcaggtaatatttcagccatgatccagtcaggggagagggcacaggcataagagggaagagccatggtgaaaccgcatctctactaaaaatacaaaaattagctggacgtggtggtgtgcatctgtaatcccggctacttgggaggttgaggcaagagaatcacttgaacccaggaggcagaggttgcagtgagccaagatgggccactgcactccagtctgggcgatagagctagagttgtctcaaaaaaaaaaaagaagagcatgagcgtagtgttccagggcacagtggtctctgttcatggcctgtttgctgctatgagggttaagacttaggggaaaagtttgccagtttctacgaatctccagagattgtttcctagaaccaggccttaactttggtggcatctttttgtgaaatgtggggacagagccacatcttgaatgtgagatagtagggtgatgcccactttgtgccacattttgttagctactgcctgtaggcattttcagtgactaaaagaggctgctagtggtggagatgaagtgtcacccaatttactaaaaaaatcaaactcttcatattacccagaagggtaactgctgttcccccacctccacatatctgcatcaagctgaagttctgtgtcctcatgagctgattttacctttacacagatattggggaacgtgatgatgatatgccctagacctcagcatcctctgtttgatgctacagagggaactgaggactaggggagagggtgtgtcctcagggtaccctgtgctgatcatgcctcgtctctcttctccaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggactctctgtttccattctccccccacagacctgtcaagagaagcatgacaaacaaaatcatttaccgactttagtgcttttttccataattaaaccgat

SEQ ID NO: 3815 - DNA, 747 bp, Homo sapiens
  Genbank Accession No. X89960
gggcatggactcactagactgctgaggaagatcaataatacctactggaatcagtcatgagaagtcaagcatggaaattgtgaattgtgtgtgtggccagaccagtacctccaagtgttcagaagatgtgtgaccagacaaaacacagtaaatgctgcccagcaaaaggcaatcaatgctgcccaccacagcagaaccagtgctgccagtcaaaaggcaatcaatgctgcccaccaaaacagaaccagtgctgccagccaaaaggcagtcaatgctgcccaccaaaacacaatcactgctgccagccaaaagccccatgctgcattcaggccaggtgctgtggtttggagaccaagcctgaagtctcaccccttaacatggagtctgagcccaactcaccgcaaactcaggacaagggctgtcaaacccagcagcagccccatagcccacaaaatgagtccaggccaagcaaatgagagcagaagaagtcaaacaaagaagaagtccctggggccatgcctttcactttgtagggtgggggattactgagagtcaggctagacctgtgtttagaggagcagttttcacagtgactaccatttccacccaatgagaggctcctatttcccatcatagctccctaccctagggaggcctccatctggaaatgggaggatgaagaggctagaatcatctttcctagtgatcctgacatttagacagcacagaaataaagagcaataaaaa

SEQ ID NO: 3816 - DNA, 1525 bp, Homo sapiens
  Genbank Accession No. X90579
ggaattcccagcccagcaaacagcagcactcagctaaaaggaagactcacagaacacagctgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggtatctcttccctgtttggaccacattacccttcatcatatgaagccttgggtggctcctgtgtgagactcttgctgtgtgtcacaccctaatgaactagaacctaaggttgctgtgtgtcgtacaactagggaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctctttagctgaggatgaagaatggaagagaatacggtcattgctgtctccaaccttcaccagcggaaaactcaaggagaaaagacatcacaaaattcattacaaaatgtcacttactgctccatgctggagaaagccatatccttctgggacttgagtctgcacatttaactacagcatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggtgaggggatgacccctggagatgaagggaagaggtgaagccttagcaaaaatgcctcctcaccactccccaggagaatttttataaaaagcataatcactgattccttcactgacataatgtaggaagcctctgaggagaaaaacaaagggagaaacatagagaacggttgctactggcagaagcataagatctttgtacaatattgctggccctggttcacctgtttactgttatcacaataatgctaagtaaaaaaaaaaaaaaaaaaaaaaaaaaa

SEQ ID NO: 3817 - DNA, 1011 bp, Homo sapiens
  Genbank Accession No. X90999
gatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagtttaacaagtatttattcccataaaaaaaaaaaaaa

SEQ ID NO: 3818 - DNA, 3880 bp, Homo sapiens
  Genbank Accession No. X91148
tgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatgctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaagaaaaagtaagacacaaacaaaccatttttttctctttttttggagttgggggcccagggagaagggacaaggcttttaaaagacttgttagccaacttcaagaattaatatttatgtctctgttattgttagttttaagccttaaggtagaaggcacatagaaataacatctcatctttctgctgaccattttagtgaggttgttccaaagagcattcaggtctctacctccagccctgcaaaaatattggacctagcacagaggaatcaggaaaattaatttcagaaactccatttgatttttcttttgctgtgtcttttttgagactgtaatatggtacactgtcctctaaggacatcctcattttatctcacctttttgggggtgagagctctagttcatttaactgtactctgcacaatagctaggatgactaagagaacattgcttcaagaaactggtggatttggatttccaaaatatgaaataaggagaaaaatgtttttatttgtatgaattaaaagatccatgttgaacatttgcaaatatttattaataaacagatgtggtgataaacccaaaacaaatgacaggtgcttattttccactaaacacagacacatgaaatgaaagtttagctagcccactatttgttgtaaattgaaaacgaagtgtgataaaataaatatgtagaaatcaaaaaaaaaaaaaaaaaaaa

SEQ ID NO: 3819 - DNA, 1932 bp, Homo sapiens
  Genbank Accession No. X92106
cagcgagccgcagcgcaatcccggcgctcgcccaaggaccctggaagctaccgttaccccgccggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggtgggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattc

SEQ ID NO: 3820 - DNA, 2588 bp, Homo sapiens
  Genbank Accession No. X92396
gaattcgccggtccagcctcctctgggagcgggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaattatttgtttcattacatctgccaagacaggattgtatatctttgtatcactgatgatgattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaaggaattc

SEQ ID NO: 3821 - DNA, 1411 bp, Homo sapiens
  Genbank Accession No. X92475
gaatttcccccagcgaggcgagtgaggcgaaatacccgtatggtgatagctggccttttcgcgccaatactgaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgattacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggac

SEQ ID NO: 3822 - DNA, 4633 bp, Homo sapiens
  Genbank Accession No. X92518
atccatgctttacactttatgcttcggccgtatgttgtgtggaattgtgacggataacaatttcacacaggaaacagctatgaccatgattacgccaagctcgaaattaaccctcactaaagggaacaaaagctggtaccgggccccccctcgacggtatcgataagcttgatatcgaattcctgcagcccgggggatcccccgctgtccctttaaccccgccgccgggcgcacgtgagcggctccgggtggcacccggcgccccggccgccgaggcagttgtatttcgaacgtgcctctggctagcagccaggcgccttggctcgcggtccgcctggcctccctcctcctcatacttttcttcctgcgcaaccccctcccctttatccgcccacgattagaggtgggcactccccccaccaccaccccctccccaacgcaagcgcgtgcacgcacacacaccacacacactcacactcacacacactcacacacactcatcccacttgaatcttggggcaggaactcagaaaacttccagcccgggcagcgcgcgcttggtgcaagactcaggagctagcagcccgtccccctccgactctccggtgccggcgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagctaagcaacagcagccctcgcagcccgccagctcgcgctcgccccgccggcgtccccagccctatcacctcatctcccgaaaggtgctgggcagctccggggcggtcgaggcgaacggctgcagcggcggtacgggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggccacaacaagttgttcagaagaagcctgctcaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgggggaggggggggtggggtggggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtacacttgtgacgtcggcattcatataggaagaacgcggtgtgtaacactgtgtacacctcaaataccaccccaacccactccctgtagtgaatcctctgtttagaacaccaaagataaggactagatactactttctctttttcgtataatcttgtagacagcttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctccctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaatgaatttacagtctagtacttattacatgctgctatacacaagcaatgcaagaaaaaaacttactgggtaggtgattctaatcatctgcagaacaaaaagtacacttaattacagttaaagaagcaatctccttactgtgtttcagcatgactatgtatttttctatgtttttttaattaaaaattttaaaatacttgtttcagcttctctgctagatttctaaattaacttgaaaattttttaaccaagtcgctcctaggttcttaaggataattttccacaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcttcttgccctgcttttgcataatgcaatcaaaaatatgagtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgtcggcttttgtcagtatggcttttagtactgaagccaaatgaaacacaaaaccatctctcaaccagctgcttcagggaggtagttcaaggcacatacctctctgagactgcagatcgctcactgttgtgaatcaccaagagctatggagagaataaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctaaataagactggacatttaacttttctaccatttctgcaagttaggtatgtttgccaggagaaaagtatcaagacgtttaactgcagttgactttctccctgttcctttgagtgtcttctaactttattctttgttctttatgtagaattgctgtctatgattgtactttgaatcgcttgacttgttgaaaatatttctctagtgtattatcactgtctgttctgcacaataaacataacagcctctgtgatccccatgtgttttgattcctgctctttgttacagttccattaaatgagtaataaagtttggtcaaaatagatcaa

SEQ ID NO: 3823 - DNA, 2165 bp, Homo sapiens
  Genbank Accession No. X92720
cccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcctgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaaggcgctatgtgcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagagccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggcctagtctagcaagaggacatagcaccctcatctgggaatagggaaggcaccttgcagaaaatatgagcaattgatattaactaacatcttcaatgtgccatagaccttcccacaaagactgtccaataataagagatgcttatctattttaaaaaaaaaaaaaaaaaa

SEQ ID NO: 3824 - DNA, 362 bp, Homo sapiens
  Genbank Accession No. X92744
gctcagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtat

SEQ ID NO: 3825 - DNA, 1883 bp, Homo sapiens
  Genbank Accession No. X92762
ccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgcccccgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagcagaatttttccaagcagagaatgaggggaaaggtgttctagacacaggcaggcacatgccaggtgctggaaaaagaagagagaaaggagatggcgtctaccagaaggggatggacttcattttggagaagctcaaccatggggactgggtgcatatcttcccagaagggaaagtgaacatgagttccgaattcctgcgtttcaagtggggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttcccccccaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgtt

SEQ ID NO: 3826 - DNA, 599 bp, Homo sapiens
  Genbank Accession No. X92896
cgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgccgcagggggtcacgaatgcggccgcacatattcaccctcagcgtgcctttcccgacccccttggaggcggaaatcgcccatgggtccctggcaccagatgccgagccccaccaaagggtggttgggaaggatctcacagtgagtggcaggatcctggtcgtccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgaggtattatt

SEQ ID NO: 3827 - DNA, 511 bp, Homo sapiens
  Genbank Accession No. X93036
  unsure (1)..(511): n = a or c or g or t
cccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattan

SEQ ID NO: 3828 - DNA, 2692 bp, Homo sapiens
  Genbank Accession No. X94563
tgtgtaacaatctcgcaaagacgttcccctccgtctcctcatcctcttttcaaacccttttacgatttcccatctcactcagcatgacagtcaaagtccctgtgatggccaacttctgcatcacctagccagtctgccaccgccaaaactctccagcctcatctttctactcttcccctggttccttgcccacgcctttacacttgttctctgcttggaatcttccctcccctccttgaggaactttctcaaatgtcaccttccctcaatactccccctcctccatttaaaactataaacttccaactctctaagcccctaaagtactctatatttaacttattgtataaactactgtccctacttgtaagttccaagattgcagggattcacccgctttgttcactgctgtctgccaaggtctagaacagtgcaagttacccaacaggagttcaataaacagccattcatttaacaaatatttgctgagcacttcgtcccgtccaagtttgttaaatcaagacaaataagacaccgtccctgcctttaacgcaccagatggagaaatgcaccacagacataaatgtgcaatacaggcctgacactacggccacaagcaagtcaaagaacgtgccaaaagttcagaggaagaagcctcggcttcgcctttcgggagaccagtccagctttccaccatcacgctgctcatcagggaccatctccgggggtctcctctagaccccaagggaggagcgggtcccgcccgccattcccaggtctcagagtttacttgtccagagatgcaacttccggcctcttcaggccgggcaagatttaaggaaagaaaagaaacataaggacctccgttcttcggtctccgtcccctccccttcccccgcgtgccgtccccacaacgggccaggactgaacccaactctcgaccaactcccggcagcaaaactaagcaccctacttccgttgtccccacctgttcccggcgtccccttcggctactcccggcgtttgcgcaagcggtcccacgtgggctcgggcggggctagcgccgcggcgggggctgggcacgcccctagcgcatagctggcttctgattggctttccggtgctcgcccgagcagggttggggcgagtggaccgcgcctctaaaggcgcttgccagtgcaatctgggcgatcgcttcctggtcctcgcctcctccgctgtctccctggagttcttgcaagtcggccaggatgtctcaggtacagcgcgtgcacagccaggctgcgaaggtgcagcgggcgggaggcccgttgggggctcagccggctgccagaagctctcgggctctttccttccgtgcccctcacttgctcatgggcccatgcctagccctgattcgttggacagagccttgtgagcgggattttccgtttggggatttctaaatctgctgcccaccccgcaactgccggaaagttgcccatggggtggacttcgctgtgtagcgggagaggggtgggagtcgagggtgcttgatggagagatgggggaaggggttgcacggattggaggagcgaggagactcagtccccatcccgaagcacagggcaggacgtcgcggcggagtggggaagcgaggagtccgtggccgggagcttggaggtcaggggaagtacggggccggctgctcagagtgcgggacgaggagaatcgcggcccggggagaggtgacccaggggcccctcccttctctccagtgtagacccttgtctgagaccgagctatgtggggcgacctctggctcctcccgcctgcctctgccaatccgggcactgggacagaggtcggtgttgaacgcgcgggccccagggggagggaggggaccaacgggctccggcgctgacaccgcggcactcatgccctgtcccctttcagctgtttccagcatactgtgccccgtctgtcctcaggccagggcttcgctgcagccccggccactccctagtgcctggcccggtggtggccaggcagttggccgcgctgcttctcccgcagaggggacccccactggggcgaaggcttggcctgccctcttcactgctgtatttccagacctgatgcctgcgtttgtgagagctctggatatatggttttcgattgaatgagtgaactggaggggcttccccttcttgtgttgctgaatctttctagctgccctgttggggcagggaggggcagacacacttcaggggctgcattgcccgaagggtgccacctttcccacctctccatccccgtaactgggctgtcatcaggccacagtaggattcttaccctctcccacccagaggaggccctcaatcctctcctctcccttccatttaggctgagtttgagaaagctgcagaggaggttaggcaccttaagaccaagccatcggatgaggagatgctgttcatctatggccactacaaacaagcaactgtgggcgacataaatacaggtatgcagagcgggggttggaagggcatctgctcatcaaagcaggctcagcagcccagactggaagtccctgggaacttcactctcaaactgcctgaggccctactcttcaggtggggtatggtgatggttcctgaggtggaaaagaccatgttccggattctcagtgtctccagtagtaacagaattc

SEQ ID NO: 3829 - DNA, 2225 bp, Homo sapiens
  Genbank Accession No. X95190
ggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcgctgagcacgggcatgaaggccatgatgtcagaattctgcacccagggagctgagatgtgccgcagggcctgtggcggacatggctactcaaagctgagtggcctgccatcactggtcaccaaattgtcggcctcctgcacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcccttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattag

SEQ ID NO: 3830 - DNA, 1020 bp, Homo sapiens
  Genbank Accession No. X95384
ggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagggtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttccaaaaaaaaaaaaaa

SEQ ID NO: 3831 - DNA, 1059 bp, Homo sapiens
  Genbank Accession No. X95404
gctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgatccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgcggtcatctccctggagggcaagcctttgtgagccccttctggccccctgcctggagcatctggcagccccacacctgcccttgggggttgcaggctgcccccttcctgccagaccggaggggctggggggatcccagcagggggaggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaa

SEQ ID NO: 3832 - DNA, 1936 bp, Homo sapiens
  Genbank Accession No. X95715
agcgctagcgcagcagccgggcccgatcacccgccgcccggtgcccgccgccgcccgcgccagcaaccgggcccgatcacccgccgcccggtgcccgccgccgcccggcaccggcatggcgctccggggcttctgcagccgatggctccgacccgctctggccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggagtggcctaccccactgccactgtggccatcctgccactgtttctcctctacgctgggtttcaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcaacccccctggcctcagggcgggcagatcgagttccgggactttgggctaagataccgacctgagctcccgctggctgtgcagggcgtgtccttcaagatccacgcaggagagaaggtgggcatcgttggcaggaccggggcagggaagtcctccctggccagtgggctgctgcggctccaggaggcagctgagggtgggatctggatcgacggggtccccattgcccacgtgggcgtgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggcctgcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctgggacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctgagccaggaccctcaaccgtaccccagttggaccagcccgcacagcctgcagtgctggagatggaagtgacccgttggtcatcgatagctccacacgatattgagtctagacctgtgtttggtctctgggagggaaaatggcagagaaagtggccaattatcacagagcatcagagccggaaggacctagcaatacacaggtctgccggcaggcccatctcgccctgtccaccctgcagccaatgtcaacagcgactctcagccccgctgtactctggactcacctgggggcctcaagcacatgcccaggctcccggctagcccttaaatcagaatctctgaggctgggaactgccatgctgtgtgtactttttacaaattaacacttttattttgggataatcccagactcacatgcagttaaagaaacaataatataaaaaaaaaaaaaaaaaaaaaaa

SEQ ID NO: 3833 - DNA, 1670 bp, Homo sapiens
  Genbank Accession No. X95876
ccaaccacaagcaccaaagcagaggggcaggcagcacaccacccagcagccagagcaccagcccagccatggtccttgaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggaccaaaaaaaaaaaaaaaaaaaaaaaaaaaaaaaaaaaaaaaaaaaaaaa

SEQ ID NO: 3834 - DNA, 1877 bp, Homo sapiens
  Genbank Accession No. X96752
cgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcatattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcaaaaaaaaaaaaaaaaaaaaaaaaaaaaaaaaaaa

SEQ ID NO: 3835 - DNA, 1205 bp, Homo sapiens
  Genbank Accession No. X97160
  unsure (1)..(1205): n = a or c or g or t
ctctcctgccatctctgtggttggcgtctctgctgggggccacacattgagccgtccaccccctgctcagatgcccagggaggtgctcaaggtaaggtgagatccagaggccctgggagggggctcctggtgactgaggagtgatcctaggagctagggatggcctcgatgcactggtgatttgggggcaaggtcttaggggctctaaggaaggtccctggtactgtttaaattatctgtgttcatgtctcatgtgttttgggtttctgagatgatcttgtgaaattgcgaggagttcgtgggggccatgaggatgtcttggtggaccatggaggctcatgagtgccccaagtgggccctggctttgtaggaagagcttcatgtgtgtgggatacattagttctttggccattagggggtcttgggaagcattgtatggttcccaggtctattaggtggtgtcagagactagtggggaatcttggggactgtgacagggttttccagaaactacgagggatcctgtcagtcatgggtggatcttggcagctgtgaaggatttctgagaaagagagtttgggtcctgggggagactcgctaatatttnttggggtgttctcagattctgggcccagcttgtctgcgtgagtctaggcaccaatgagttaggagggtcaggctggggctcagaattcacccctttgagtcctgttctgccttgtcccctctctttccttgtntaccttatttcacaggtgcagacccatctggagaacccaacgcgctaccacctgcagcaggcgcgccggcagcaggtgaaacagtacctgtccaccacactcgggcccaagctggcttcccaggccctcaccccatcgccggggcccgcaagtgcccagccactgcttgcccctgaggctgcccacactaccggccccacaggcagtgcgcccaacagccccatggcgctgctcaccatcgggtccagctcagagaaggaggtaagaggctacagccaaacctcctcccacattcccctcccaaattcttctaaacctgtataatatttacttcttcccctagattgatgatgtcattgatgagatcatcagcctggagtccagttacaatgatgaaatgctcagctatctgcccggaggcaccacaggactgcagctccccagcacggtgattgtaactcttgg

SEQ ID NO: 3836 - DNA, 1314 bp, Homo sapiens
  Genbank Accession No. X97324
atggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcaatttgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 3837 - DNA, 1315 bp, Homo sapiens
  Genbank Accession No. X98337
ggaattcgggcacgagtgaaagatttcaaaccccaaacagtgcaactgaaacttttgcattactatactactgagaatatctaacatgttgttactaatcaatgtcattctgaccttgtgggtttcctgtgctaatggacaagaagtgaaaccttgtgattttccagaaattcaacatggaggtctatattataagagtttgcgtagactatactttccagcagctgcaggacaatcttattcctattactgtgatcaaaattttgtgactccttcaggaagttactgggattacattcactgcacacaagatgggtggttgccaacagtcccatgcctcagaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattaaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccattttccaacatgttataattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatgtatgtcaacttcacttctcactcttatggtctcaaagcttcgaaagatagcttctgatattgttgtaatttctactttatttcaaagaaaattaatataatagtttcaatttgcaacttaatatgttctcaaaaatatgttaaaacaaactaaattattgcttatgcttgtactaaaataataaaaactacccttatattggaaaaaaaaaa

SEQ ID NO: 3838 - DNA, 340 bp, Homo sapiens
  Genbank Accession No. X98482
  unsure (1)..(340): n = a or c or g or t
ggaggccgggcaccattgtttcaagactctggaaggaaccntcccccaggaattcccttgccaccccatgcaggtttctgtacgtgcgatgtnaccttctccctatgcacacctgggtgggctttgcttcttctccttaggagagacgtcgggcagagcgggccgagcagcagcgcatccggaatgagcgggagaaggagcggcagaaccgcctggctgtgagtgacccctagcccaggcccatggaggccccccatgctcccagctcctgctgcccgggcctctctattcatcaacatgaatgaaatcagtcaagagacaatattggccgggtgcggtg

SEQ ID NO: 3839 - DNA, 5869 bp, Homo sapiens
  Genbank Accession No. X99133
ctcgaggatctcggctcactgcaacctccgcctcccaggttcaagctgttcttctgcctcagcctcccgagtagctgggattacaggcgcctgccaccatgccctgctaatttttgtatttttagtagagatggggtttcaccgtgttggccagactggtctcgaactcctgacctcgtgatccacccgcctcagcctcccaaatgctgggattacagatgtgagccaccgcacccggcctggcagaggatactttttaaggtcaaagacagtagcagaggtggagttcctgggaacagggtcatgaggggaagagggggttcggagggagcgagtagccactggctacctctagaaagggaaggctttggtgcaacatcgttcccctgcagttttactcatctttgcttcctgccctttcatcatccaatcgggcaggcaggacagggcctgagggggcagggatccagtgggtgcctctctagactaaccccagctcaggactcccagagccccttccctgaggccctgctgcccccaagcccagattggggatcccaagcagcacgtaggcagagccagtgaggtccccgttagtcccattgaaagctctaaaaccagcgaaccctcagtccagcctcaggtcaggcatccaggacggcctcagccctcatgggtgagccatctctgcggacactgcacagggcctacgatccatcgctgcctcccgaggatgccagccaggcccccgttgagataactgcttccctgctggacaaggctgggaccagccatctcggtgacagttccagaacccctggcctgggctgctgggttcaatggaaaaaggctgtgactagagtcagggggatggtctcagtgacctcaaggataaggccagatccttgcactgtcagtgacccaaagcaacaggtgtccagagcagcagtgtggcgccttcacgcccccacacatcagcccaactcacccaggacagggactgtagcctcagcactcaacccatgtgccctgtgtggggtctcttcccactgcactcacaggagaggaagggtccctcaggggtccactggggtcccctcctgcaaatggggcaaggagaggggcaaggggctgtctcaaggcccctggagcacatgcaggtcctggactggggctcctgggagggccatgattctgggctccatgagttcagagcagacgccttgtttttccttgtccactgtcagccaccccacccttccctgacccttaaaagaaccaggaaacagcacatgatctgttggaaggaggcattcattctttcctttctgtgggtgtggggaggggaccacagggcacataccccaccctgggatccagctgagcaggggggtcagagatgacagctcttccggctcacaggccaccggcccacatacagggcaatcagaagaaagaaacagcacaaggaaggcacagagggagtcgttgtccctgccagaggtgcagcactccgggaatgtccctcactctccccgtccctctgtcttgcccaatcctgaccaggtgcagaaatcttgccaagtgtttccgcaggagttgctggcaattgcctcacattcctggccttggcaaagaatgaatcaacccaccctagatcccataaatagggccacccaggtgagcctctcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaagtaaggggccaagaggggcacctgcaggcagggcctggggaagagtgggagcagaggggaggagaggtgaagagactcaggaagagcgttgggcaggacttaggagtccagggtccaggtttcagctcactctgtgccaccagggtcccctggtggaaaccatgccccttccccccatccccaccccctctcagcctgaacagactcccccaggtccacatcccctctcccataacccccattgtccaaagaaggtgggagcacttttagtccccctgcacagatgaggaaactgaggctcaggaaggcccaccagccacatgcctcctccagtgaggaggtcaccctcctccctgccagactcagaaccgcctcttcccccaggactcccttctggactgatggcctcctgctcctgccccttcaccagtgcaggcccagcctgggccctgctgcccagctagaggggctcatggttccaagctgggcggcccagaggtgccacagggacagagctggaggggtggctcctagggccattcctgggttgtgcctcttatcagtcccttgcagttccaggggaagtggtatgtggtaggcctggcagggaatgcaattctcagagaagacaaagacccgcaaaagatgtatgccaccatctatgagctgaaagaagacaagagctacaatgtcacctccgtcctgtttaggtgagggccgacatctcctgggggtgtgagagtcagactgacgtcacaggcaagggatggccaaagctgagggatcctgtcgttcacctcgctgttctgcccggaattcatctgtgttcatccttcctctgttccttagagcaacgtttatagcacatttccatgcagacacacagacagtggtggggatggacatgcacagtcgttagaaaacaagacggagagaggaggggtgcctgggagcgggaggaggggacactggatccagcctggaaccccacccagtgccttcatggaaggcttccagggaggtggccttaaaagagccaacctgcttcaaaaggaaatgtggggtgttcccggcaggggctggagtcagagagagcccccccttcaggaaggagcaagccatcgcagggtcaccctgagcagagctgctgagcagcctggaggggcaggtggccacgctagcacctagcacggtcctcaggccccgccccagcggatctgctgcggagtggcttagagcagggctcttgggccgcagggtggggagacttggtggggtgcagcctagggggtcgggagaccagcgaaagtgaagcggggccgtcacaggtgtgagagaacaggcgcagggtgaagaggcagggagccagggatcagccgcccccagtgggtttctgactctggcagctgagtggattgggattggggcatttgtggagcaaggagcagaatacagacaggttggggagctcagccctggggtgccaggggatgggaagtgggaggactcaaggatggggtcaggtttgacccgagagctaggggaacggctggcatggagcagactggaagtaccgaggtggatccccgggagagggtataggaagggaagcagcaagctgagtgcaggggagaaatgcagggtttcctgtgtgttgggtggcggcgggggtgaaagccacccagggaggcagccaaaggaaagaaggacatcgggtgctggagggtctgagtggggtccaggggccccaggcaggccaggagggacagcctggtgtcagctcagggagaaggcccaggcccatctcggctgggtggggtagggcccctccaggtagtgggggatgagctgtcacgggttgggccggactgagagcaacagaaccctgctgctgccctggccccaccttgtccagcacaggaggcccaagcctgggttgtctcccctctcacccacccatctctccctcccaaggaaaaagaagtgtgactactggatcaggacttttgttccaggttgccagcccggcgagttcacgctgggcaacattaagagtgagtcttgagtgaggtggggcactgagttggggctccggggagctgggtaggggcacagaccttcctgcccctccacacagatgtgttgtatggggagaagcccacgttgatgggctggggagggaggggacagctccctcctcccatccagggcagggctgacccctcaccgtccacgcctgcaggttaccctggattaacgagttacctcgtccgagtggtgagcaccaactacaaccagcatgctatggtgttcttcaagaaagtttctcaaaacagggagtacttcaagatcaccctctacggtgggtcctctcccatcccctcggggactggctcctgatcacacttagtgggaggggaggccggtcccccatgaggaagggatctgaggcctcatctactcattcaacgatatttatgtggtgtctgccggccactcactggccatcttggtcacagggagaaccaaggagctgacttcggaactaaaggagaacttcatccgcttctccaaatatctgggcctccctgaaaaccacatcgtcttccctgtcccaatcggtaatggccagtctggatgaggggacggggacatggggactgttcaggcaggatgcttccctaccagggatcagggagaggagggactccgtcctcagcttcagtcactggagcagtggatggtccaggagctccttggaagccactctgggcccaggaagactgtgccccaccccagggtctatgggactcccagggacccaggccgcaagtgctctttcctggcagtttagcccgggtctgcccagacaaggatttcaggcccaggcctgagtatccatttctcagtctcactggcctgacacctctggccaccctcccaggcccccttgttctgggccatctcccccgaccctcccaggcctcgtcaccctgggttttgctgtcctggctgtcctctctcccctggggacttgctcaccactgacttgggagctgtccttgactccagggagcctggcttgggcaggaggctccagccaggccattcagagagccactggcctcccccaggctgagagactgcctggactggtaaacaggcaggagacctgggtgcccgaggagcctgggagctgggcctcactcagggcagcccctccccaggcctttctcccacatcccctgccctgccatccacccctctgttgccccatctctgaaaggaacccccatatcttctgcagctgggccaggtggggcaggggctgcccaggggcagtgcagaggacctggcagtcagggatcacacacacacactcatacacgcacacacacacacagctgcctgttctgacggactttctccctaacagaccagtgtatcgacggctgagtgcacagtgagtgtggctgggcggctgcgagggggcttgtgggaggccagggtgcagtgggctgggggtcttgggcctgcctttgctcatccccctgccccccagcactgctgctgtctttattctgctgtccccatctcgggtgcctcccatttccccacccatcaccctcatatccacctctgtccagggtgccgccagctgccgcaccagcccgaacaccattgagggagctgggagaccctccccacagtgccacccatgcagctgctccccaggccaccccgctgatggagccccaccttgtctgctaaataaacatgtgccctcaggcctctgagtctacactgtttgacccctgggccttcgaggaaggggaggggcgggaggctcccactggcatcactctcagggtctgcacccccaggatggagcctagcgaacccagcctgggtgttagggctgcagagtgaagacacaagcccctggtcatcaccagcagctttgtgg

SEQ ID NO: 3840 - DNA, 481 bp, Homo sapiens
  Genbank Accession No. X99920
tctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaaaaaaaaaaaaaaaaaaaaaaa

SEQ ID NO: 3841 - DNA, 2468 bp, Homo sapiens
  Genbank Accession No. Y00097
ccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacctagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgacaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctagagcctctgccctggtttgggctatgtcagatccaaaaacatcctgaacctctgtctgtaaaaaaa

SEQ ID NO: 3842 - DNA, 2093 bp, Homo sapiens
  Genbank Accession No. Y00317
agcagcaactggaaaacaagcattgcattgcatcaggatgtctatgaaatggacttcagctcttctgctgatacagctgagctgttactttagctctgggagttgtggaaaggtgctggtgtggcccacagaattcagccactggatgaatataaagacaatcctggatgaacttgtccagagaggtcatgaggtgactgtattggcatcttcagcttccatttctttcgatcccaacagcccatctactcttaaatttgaagtttatcctgtatctttaactaaaactgagtttgaggatattatcaagcagctggttaagagatgggcagaacttccaaaagacacattttggtcatatttttcacaagtacaagaaatcatgtggacatttaatgacatacttagaaagttctgtaaggatatagtttcaaataagaaacttatgaagaaactacaggagtcaagatttgatgttgttcttgcagatgctgttttcccctttggtgagctgctggccgagttacttaaaataccctttgtctacaggcctcgcttctctcctggctacgcaattgaaaagcatagtggaggacttctgttccctccttcctatgtgcctgttgttatgtcagaactaagtgaccaaatgactttcatagagagggtaaaaaatatgatctatgtgctttattttgaattttggttccaaatatttgacatgaagaagtgggatcagttctacagtgaagttctaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggaaatggaagagtttgtccagagctctggagaaaatggtgttgtggtgttttctctggggtcgatggtcagtaacacgtcagaagaaagggccaatgtaattgcatcagcccttgccaagatcccacaaaaggttctgtggagatttgatgggaataaaccagatactttaggactcaatactcggctgtacaagtggataccccagaatgatcttcttggtcacccaaaaaccagagcttttataactcatggtggagccaatggcatctataaggcaatctctcctagaatccctatggtgggcgttccattgtttgcagatcaacctgataacattgcacacatgaaggccaagggagcagctgttagtttggacttccacacaatgtcgagtacagacttactcaatgcactgaagacagtaattaatgatcctttatataaagagaatgctatgaaattatcaagaattcatcatgatcaaccagtgaagccccttgatcgagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccgactgacagtatcagtactgttttgcaaatactcagcatactttggatccatttcatgcaggattgtgttgttttaactgttgttgaggaagctaataaataattaaattgt

SEQ ID NO: 3843 - DNA, 1965 bp, Homo sapiens
  Genbank Accession No. Y00318
  unsure (1)..(1965): n = a or c or g or t
gagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtggctcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcnngcgaattc

SEQ ID NO: 3844 - DNA, 1523 bp, Homo sapiens
  Genbank Accession No. Y00339
gtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtaggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattct

SEQ ID NO: 3845 - DNA, 2156 bp, Homo sapiens
  Genbank Accession No. Y00451
gttgcccttgtcgacttgagtgcccgcctccttcgccgccgcctctgcagtcctcagcgcaggagccagcatacttcctgaacatggacagtgttgttggccgctgcccattcttatcgcgagtcccccaggcctttctgcagaaagcaggcaaatctctgttgttctatgcccaaaactgccccaagatgatggaagttggggccaagcagccctcgcggattgtccactgcagcagtacactaccacaagatcaagaaacccctccggccagtgagaaagatcaaactgctaaggccaaggtccaacagactctgatggatcccagcagagtccagatggcacacagcttccgtctggattccgtctggacaccccttgctgccacaagccagggcactgcaagcaaatgccctttcctggcagcacagatgatcagagaggcagcagtgtcttctgcaaagccagtcttgagcttcaggagggatgtgcaggaaatgaatgccgttaagaaagagggtgctgaaacctcagcaggccccagtgtggttagtgtgaaaaccgatggaggggatcccagtggactgctgaagaacgtccaggacatcatgcaaaagcagagaccagaaagagtgtctcatcttcttcatgataacttgccaaaatctgtttccacttttcactatgatcgtttctttgagaaaaaaagtgatgagaaaaacgatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcctgctttgtggcccatgactcaaccctcttcaccctggtcaagatgatgccaggctgtgagatttactctgattctggggaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcagtggatggggcggtgctgccactggaagagctgtgtgatgtggcccatgagtttggagcaatcaccttcgtggatgaggtccacgcatgggggctttatggggctcgaggcggagggattggggatcgggatggagtcatgccaaaaatggacatcatttctggaacattgggcaaagcctttggttgtgttggagggtacatcgccagcacgaggtctctgatggacaccgtacggtcctatgctgctggcttcatcttcaccacctctctgccacccatgctgctggctggagccctggagtctgtgcggatcctgaagagcgctgagggacgggtcgttcgccgccagcaccagcgcaacgtcaaactcatgagacagatgctaatggatgccggcctccctgtggtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctaaggcctgagcatgacctcaattatttcacttaaccccaggccattatcatatccagatggtcttcaagttgtcttatatgtgaattaagttatattaaattttaatctatgataaaaacatagtcctggaaataaatctgcttaatggtgaa

SEQ ID NO: 3846 - DNA, 1360 bp, Homo sapiens
  Genbank Accession No. Y00503
cgggggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctggcggatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggg

SEQ ID NO: 3847 - DNA, 368 bp, Homo sapiens
  Genbank Accession No. Y00705
gaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaggtcggaaacgccagacttctatcctcattcaaaaatctgggccttgctgagaaccaaggttttgaaatcccatcaggtcaccgcgaggcctattgttgaataaatgtatctgaatatc

SEQ ID NO: 3848 - DNA, 515 bp, Homo sapiens
  Genbank Accession No. Y00764
ggggggctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgattcctctcgatcacatacagaagaggattgcacggaggagctctttgacttcttgcatgcgagggaccattgcgtggcccacaaactctttaacaacttgaaataaatgtgtggacttaagttgcaccccagtcttcatcatctgggcatcagaatatttccttatggttttggatgtaccatttgtttcttatttgtgtaactgtaagttcacatcaacctcatgggtttggcttgaggctggtagcttctatgtaattcgcaatgattccatctaaataaaagttctatgatctgcaaaaaaaaaaa

SEQ ID NO: 3849 - DNA, 2303 bp, Homo sapiens
  Genbank Accession No. Y08302
cgcttcccgccgcccgagcttcggaaacttcccggccgcgacgcagggaaccggcgcggagaaccgagcagagcggagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaagcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagataaaaaaaaaaaaaaaaaaa

SEQ ID NO: 3850 - DNA, 1635 bp, Homo sapiens
  Genbank Accession No. Y08374
aaaggaagagaaagggagagagggagagaagagggagagagcagagagacctcaccgagagagctgcaaaaccagcctggaaaaattagagtattacctaacattagtgaaaaataaaggtactttcttgagaagcccttggacccattctgcctcctggagttctgaacttttcactcactgcctattaattaatgttaagcctgcaaagaatggagttgtcctggatatttggccaaaaaaaaaatgtatccacaaacagggacgtaatcaggcagggagcctcgttaagaagttttgttcttgtcctaggagtgatgagagatcactgaaggatttagagaggggctgtatcatcaggcttgggttccaaagcctcactgagagagttggggagctgactgatgtcagatgctcgtgcagccgccccgtagggcctgtatttcctccatggtgcctcactgcagcaccgagcttgcaaaagatcctctctctttatgggaatttcaaaacagaagcaaaatagcaccggggcttaaagcattcttgggaatttccctgtctttccctctaaataatcagcatgtaaattgcaaaaaaaaaaaaaaaaaaaaaagacacgggcccaaaagggagcgctcagtttcaggctctttgctttccttcctcccgaggctctctggcccttacccagcctgaaaacaaaaagtgtgagggggagggtaggaaggtagttcaagcagggcaatgctgagcctgggaagaaaacaacagccttgtttagggcactgtggcttacgtaactaaattgtgcccagtttccacctggccaggggcctggagtgaatgctgaagatgcaaaggtagaggctgccagaaaagccaggaaattgctggcaagaaaggccagtggtggggtgcaggagtgggaggaaggctgggaaatgcggctgagtcacatctccagaagccccccatcatcaccctagtggctcttctgctggcaggcgcctcatgaagacctgacccaaagttttcaaaactctgcggtttctcaaccctcctctggtaatccatagtactcccccgcctccacttgccagcctcgtgattccttcatggacacatagctcagttcccataaaagggctggtttgccgcgtgggggagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggtatctgggctagccaaggttaatccatcagagttgtgggttttcaggcccagacagcccgcagagccatctgcctgctgggtgagggactaagggagtgggcagagggggaggagaagcagagccaggggagggactgaggctgcaaccaggaggtgggggtgggggagtgggtctcagttgcttgggggagggagcagggcggaagggcaggatgcacttgcaggggtctcatcctggatttctcttcaggctttgtggtcctggtgctgctccagtgctgtgagtaatccctccacctccacttttaagtcca

SEQ ID NO: 3851 - DNA, 461 bp, Homo sapiens
  Genbank Accession No. Y08409
ggaagcaaccatgcaggtgctaaccaagcgttaccccaagaactgcctgctgaccgtcatggaccggtatgcagccgaggtgcacaacatggagcaggtggtgatgatccccagccttctgcgggacgtgcagctgagtgggcctgggggccaggcccaggctgaggcccctgatctctacacctacttcaccatgctcaaggccatctgtgtggatgtggaccatgggctgctgccgcgggaggagtggcaggccaaggtggcaggcagcgaagagaatggaaccgcagagacagaggaagtcgaggacgagagtgcctcaggagagctggacctggaagcccagttccacctgcacttctccagcctccatcacatcctcatgcacctcaccgagaaagcccaggaggtgacaaggaaataccaggaaatgacgggacaagtttggtagaccttggaca

SEQ ID NO: 3852 - DNA, 1157 bp, Homo sapiens
  Genbank Accession No. Y08999
ccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgtattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgaggctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagaaagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttatctacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgga

SEQ ID NO: 3853 - DNA, 827 bp, Homo sapiens
  Genbank Accession No. Y09216
gtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgaaaaaaaaaaaa

SEQ ID NO: 3854 - DNA, 2191 bp, Homo sapiens
  Genbank Accession No. Y09616
tcgagcggccacccgggcaggtctctgggtgaatagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccagaagttgattccttcattcacttcgccattcattcatacttccgtccatccattcagaaaccggyatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaaagagagagtgtgtgattagaagctaaataggaaagttttgagcttcaagtcagtgaggagtaaaaaagatttttaaaaagcaa

SEQ ID NO: 3855 - DNA, 2370 bp, Homo sapiens
  Genbank Accession No. Y10032
cacgagggagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgatttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgagctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaattttttgaagagcacattctcctcagtgagctcatgaggttttcatttttattcttccttccaacgtggtgctatctctgaaacgagcgttagagtgccgccttagacggaggcaggagtttcgttagaaagcggacctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcctaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaataaaaaaaaaaaaaaaaaaaaaaa

SEQ ID NO: 3856 - DNA, 4039 bp, Homo sapiens
  Genbank Accession No. Y10659
tgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcaagcgggccgccaccgcggtggaaactccagctt

SEQ ID NO: 3857 - DNA, 1262 bp, Homo sapiens
  Genbank Accession No. Y10807
gtgggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgtgtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 3858 - DNA, 1890 bp, Homo sapiens
  Genbank Accession No. Y12711
gacccacgcgtccggggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccactaaaaaaaaaaaaa

SEQ ID NO: 3859 - DNA, 3498 bp, Homo sapiens
  Genbank Accession No. Z11559
gggctcgaacgcgcagcgcacgggaaccggtcccgctgcttgggtcaggttcgccggtcgcgggagccccgccgtgcagtcggaggaacacgtggccatcagtaatcatgagcaacccattcgcacaccttgctgagccattggatcctgtacaaccaggaaagaaattcttcaatttgaataaattggaggattcaagatatgggcgcttaccattttcgatcagagttcttctggaagcagccattcggaattgtgatgagtttttggtgaagaaacaggatattgaaaatattctacattggaatgtcactcagcacaagaacatagaagtgccatttaagcctgctcgtgtcatcctgcaggactttacgggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaagggcagacagtttacagaagaatcaagacctggaatttgaaagaaatagagagcgatttgaatttttaaagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgtcggtggtattgaagcagaagctgtcatgctgggtcagccaatcagtatggtgcttcctcaggtgattggctacaggctgatggggaagccccaccctctggtaacatccactgacatcgtgctcaccattaccaagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtcgtgatgaagaaaaattaaagtatattaaaaaatatcttcaggctgtaggaatgtttcgagatttcaatgacccttctcaagacccagacttcacccaggttgtggaattagatttgaaaacagtagtgccttgctgtagtggacccaaaaggcctcaggacaaagttgctgtgtccgacatgaaaaaggactttgagagctgccttggagccaagcaaggatttaaaggattccaagttgctcctgaacatcataatgaccataagacctttatctatgataacactgaattcacccttgctcatggttctgtggtcattgctgccattactagctgcacaaacaccagtaatccgtctgtgatgttaggggcaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtttgacgtggtgggctatggctgcatgacctgcattggcaacagtgggcctttacctgaacctgtggtagaagccatcacacagggagaccttgtagctgttggagtactatctggaaacaggaattttgaaggtcgagttcaccccaacacccgggccaactatttagcctctccccccttagtaatagcatatgcaattgctggaaccatcagaatcgactttgagaaagagccattgggagtaaatgcaaagggacagcaggtatttctgaaagatatctggccgactagagacgagatccaggcagtggagcgtcagtatgtcatcccggggatgtttaaggaagtctatcagaaaatagagactgtgaatgaaagctggaatgccttagcaaccccatcagataagctgtttttctggaattccaaatctacgtatatcaaatcaccaccattctttgaaaacctgactttggatcttcagccccctaaatctatagtggatgcctatgtgctgctaaatttgggagattcggtaacaactgaccacatctccccagctggaaatattgcaagaaacagtcctgctgctcgctacttaactaacagaggcctaactccacgagaattcaactcctatggctcccgccgaggtaatgacgccgtcatggcacggggaacatttgccaacattcgcttgttaaacagatttttgaacaagcaggcaccacagactatccatctgccttctggggaaatccttgatgtgtttgatgctgctgagcggtaccagcaggcaggccttcccctgatcgttctggctggcaaagagtacggtgcaggcagctcccgagactgggcagctaagggccctttcctgctgggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaagctggatactggcaagaccttccaggctgtcatgaggtttgacactgatgtggagctcacttatttcctcaacgggggcatcctcaactacatgatccgcaagatggccaagtaggagacgtgcacttggtcgtgcgcccagggaggaagccgcaccaccagccagcgcaggccctggtggagaggcctccctggctgcctctgggaggggtgctgccttgtagatggagcaagtgagcactgagggtctggtgccaatcctgtaggcacaaaaccagaagtttctacattctctatttttgttaatcatcttctctttttccagaatttggaagctagaatggtgggaatgtcagtagtgccagaaagagagaaccaagcttgtctttaaagttactgatcacaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtg

SEQ ID NO: 3860 - DNA, 2148 bp, Homo sapiens
  Genbank Accession No. Z11737
aagacaaacactttccttgactttgagaaataatttaagtcaaagaatctgctctatgctaaccaagagatagagcacagcaaagatctgccagccccaggcctctacctagtggcctggaaattcaagtattcttattggtggaggccatttgtttctgattagaagctgtctaaacctcctactcctcaactcaaaggaaaacacagagcataccatggccaagaaagttgcagtgattggagctggtgtgagtggcctctcctccatcaaatgctgtgtggatgaggacctggagcccacctgctttgagagaagtgatgacattgggggattatggaagtttactgaatcttccaaagatgggatgaccagggtctataagtcattagtgacaaatgtctgtaaggaaatgtcatgttacagtgacttccctttccacgaagattatcctaatttcatgaaccatgaaaaattttgggactatctccaagaatttgctgagcactttgacctcctgaaatacattcagtttaagaccactgtgtgcagcataacgaagcgtccagacttctccgaaactggtcagtgggatgttgtcacagagacagagggcaagcaaaatagagctgtctttgatgctgttatggtttgcactggacatttcctgaatccccatttacctttggaagcctttcctggaattcataagtttaaaggtcagatcctgcatagtcaagagtacaagatcccagaaggctttcagggcaaacgcgtcttggtgattggtcttgggaacactggaggagacattgctgtggaactcagtcgaacggcagctcaggtacttctcagtactagaactggtacctgggttcttgggcgctcttcagattggggctatccttataatatgatggttacaagaagatgctgtagttttattgcacaagttctgccttcacgttttctaaactggattcaagaaaggaagttgaataagagatttaatcatgaggattatggattaagtattaccaaagggaaaaaagcaaaattcattgtgaatgatgagctgccaaactgtatcctctgtggggcaatcactatgaaaaccagcgtgattgaatttacagaaacctctgctgtctttgaagatgggacagtggaagaaaacattgatgttgtgatcttcactacaggatatacattttcttttccattttttgaagaacctcttaaaagcctctgtacaaagaagatatttctatacaagcaagtctttcccttaaacctagagagagcgacattagccatcatcggccttatcggccttaaaggatccatcttatcaggcacagagctccaagcacgatgggtcacaagagtattcaaaggactctgtaagatacctccatcccaaaaattgatgatggaggctactgaaaaggaacagctcattaaaaggggagtgtttaaagacaccagcaaagacaaatttgactacattgcctacatggatgatatcgctgcctgcataggcacaaagcccagcatcccacttctgttcctcaaggatcccagactagcttgggaagttttctttggaccatgtactccttatcagtaccgcctcatgggccctggaaaatgggatggagccagaaatgccatcctgacccagtgggacagaacattgaaacctttaaaaactcgaattgtccctgattcctccaagcctgcctccatgtcacattatttaaaagcctggggggcacctgtcctacttgcctctcttctacttatctgtaaatcttcacttttcttgaaattggtgagagataaactacaggacagaatgtccccttacctagtaagtctttggcgaggatgaacctgattgttacaagggttacaccaagtcatgctaattctatctccaagtatcttgtgcatccctcctctgctctccatcataactgctattagccaaattcaggcccagtcatctcctatctgaattattgtattatcttcttctttgttttcagtaccctctttcttgccaccctttccaatgcatcttctaccctgctacctcagtgattattctaaaataaatatatatgatatggtttaaaaaaaaaa

SEQ ID NO: 3861 - DNA, 2038 bp, Homo sapiens
  Genbank Accession No. Z11793
gcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatcatcgaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggttttctgttggataattagcagtttagaatggaggaagaacaacaaagacatgctttccattttttcctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaaggcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaaaaaaaaaaaaaaaaaaaaa

SEQ ID NO: 3862 - DNA, 1743 bp, Homo sapiens
  Genbank Accession No. Z14093
ttggttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggcgcagggggacctgacagcacaccactgtcttccccagtcagctccctctaaaatactcagcggccagggcggctgccactcttcacccctgctcctcccgtgttacattctcaggggacagcatctgcagcagttgctgaggctccgtcagccccctcttcacctgttgttacagtgccttctcccaggggctgggtgatgggcacattcaggactagaagcccctctgggcatggggtggacatggcaggtcagcctgtggaacttgcgcaggtgcgactggccagcagaggtcacgaataaactgcatctctgcgcctggctctct

SEQ ID NO: 3863 - DNA, 365 bp, Homo sapiens
  Genbank Accession No. Z20777
ctctgaacagacacgaagctgcccctcgtacagccactcgggcgctgaccaccagggaaggcaaaggcataggacttccacacagtccagacactgcacgctgacaagcgcctccgcggcggctgcgagccggactcaggcggatcttgacagccttgcccgcgagtgcccggggatagaacccgtgcgcgtggacctaggtgactgggaggccaccaagcaggcactgggcagcgtgggccccgtggacctgctggagaacaacaccaccgtcgccctgccgcagcccttccaggaggtcaccaaggaggccttcgacagatcctttgaggtgagcttgcgtgcgatcatccaggtgctgtaga

SEQ ID NO: 3864 - DNA, 991 bp, Homo sapiens
  Genbank Accession No. Z21507
gggatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtgcgaggtgcctcccgccaggagaacggcgccacggtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgagggccctgccacgattaaagactgagaccggcaaaaaaaaaaa

SEQ ID NO: 3865 - DNA, 1231 bp, Homo sapiens
  Genbank Accession No. Z23090
gagggaactggtaatagaatttattcaaatgtgccttaatataggcgctggggcttgcccatggtgctcttgatatataaggcccggacattctgccagtttttcttgagcaatgacaccaagaagttgacagccaggtgaatgttatacacaagctcatcgtctgtcatcttcacgtgaccaacagctacagccagacataacaccttcttcatttggaacttgattgtggacttcacctcatccactttggccaccatgttttcgttgtgtgtgagcagggaagggaactttcctgccttatttaaacctgggccgaggattcgtggaatctgcttgatcagagactctgaggccaaaacgcatcatacttcttggccagcttcttgaccagttttttattcttgttgagttttttcagcgcctcgatgtccatgtgggggatatccacggccttagcctcgtcaagacccacaccagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgt

SEQ ID NO: 3866 - DNA, 6165 bp, Homo sapiens
  Genbank Accession No. Z24459
  unsure (1)..(6165): n = a or c or g or t
tctagaagattgactcatgcaaaatgcacatcaagttattgtgaggtcctgaaatgatatctggggcttgggcagaggatcgttatagagtttgccctaccactcaaatgctttgggaggtatgcttcctttacacctctcaaatgtgcttctggtcttctggcttaggaagtcaaaatttaaacctagtcctctatggaaaaatgggctcctgtaacatcctgcagaattattaaaataaaacaaggacctagatggataactttcatttgcactcactcagctccaaatcagcatgatccccaaagtctcttgcagctcagaaattccatgaagctagcttacttttcctaacaagaaaatccccttctagaaatgcccatccgctatttgtaaactttcttagtaaactgataaatagatcatttgcccttaaaacaaacttttaatttcaactctgaaagacatgcatatatgtccttcagaatcttaccttttaaaatggaaactgcttggaagtggcttttacctggggaatatgacatgcatgtgtctgttatactgccttcctgccaaaataagtgtgtctttaggcacgctctttgcatattctattgctaactacattttgccagacactgcttgtgaatgcagtatgtgtgagaccactgcccagcttcctgtagtgctagtcctacatttccacacagaactcctcacctagccaaattcttgagcgctttgcagtcagcagcactacctgaggctctgcctgagtgtcactttagttgtcttgcagaaagcttcagatgtccttggttctatttaggttgtgcaaatagacatatgaggtttggttctggttagtggttgctagtaccagatcaccttgcttactggtgagttcattcaaacccaaaaagtcacacctgtgtcctgtgcgcgggtgctgcaggcttaggtggagaaaagcagggctagaattggaacccaaagcccagaatggcaggagaggatgtgggggctccacccgatcacctctgggttcaccaagagggtatctaccgcgacgaataccagcgcacgtgggtggccgtcgtggaagaggtaactgtttacattttgcttatttctttgattttgctttcaagtaacttggtttctattccagtctcaatattctgaagtctttggttttatttttgatcattcctttccattaggagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtacacatgttgcttaattattttccattgtactgggactctcgtaacagagtactccataaacttttctttttctgacaggtcaggggagtacaggagctgttgcttaagcttttgcctgatgactaacctggtatgtatttctatttctcctctgtcctccccctctttgttttggctctattcagttgtggtgattttaatgatttttttttccaggtgctgggattctacgaagatatgctcctttgttctgttcagtatttggcaatcacttcatccactactgcagtgcacccacccttgggcctggggggagggagtgggttgaaaaactgctcaagaaacagaagtttagcaagggtcatgaagaatactgcaagtgaaactgcagagagaggttacgtaggcagaaagcaagtcaacaaaagcacttagtcaggatccgtaacttgaaattgactcctttggaaattgccatagaacccttaatggacatcatcggctggacctgggatctgatgaatcccacaaaagtcagcaccttctacagaacagatgccctgatcaccaaggacttggtactgatttagagagaagagagcagctcctagcagcatcaacatctatttgtcgcttatttgccctgcagcaattcacctgcctttccttctcccatcctgtaaatatcctaggttttgctccagtgtttcccatcccagtactgacctaatttggatctgctgagtatttagagggctctgaaaagagatatgcattgatgaaattagctacaaaggcttgtgggcctttttttctatctgaaatcgtgtcttcaaattactggaagttgctgatcaaaattgtgggctcttgaattcaatcaactcttttgaatactgtaaaccaacgttaggctagaggagccgacgggcagtggctctatcattcgcagaagaaacccttgataaatgattaaactccttgagctttttttattacgcatatataaatgggaatcatacctacctcaaagcattnnnnnnnnnnaaaaccttacttttaatgtatataaactgttataactactttaactcaggaaattctttacaagatgtaaatgttttcctaggaatcagcaatatttggtgttattacttcctgagaaaggtgccagttaagcagctaaaatggtttttcttgaagttctatagaaaccacgttatttaaaatatctgtaatcagagaatgaattcaaggttttttttccatgtaaagctatttatatcttccaagcctaatgaaatggatattataaaaatacagttgattcatcctatgtttgggaagagtatttttagtgtaattattttccagcaattgtaagggcatatagtgcttgtctcagaagaaaattccacgtagaggggctttaaagtctttatggaaaaaagaaaaataaaaatcatttttcttgttttagttttctggatatgccgcagaaggatccgtgccagaagcaagcctgtgagatacagaaatgtttacaaggtagtatattgtaaaatgctttaaaaatatttttccactgtgaactaactataagagaccaattattcttttatctgtattaactcttttttaagaatgtaacgtatatgtaattatcctgaagattctcttcattgtatcaaagatgcagaaaataaaaagtaatgtgatcaaagctaaaaatttcactccaggtgattagcatcacctggagatctttaaacacttacctagaacaattcagacttcctagggctagggctagaaaaaaagggttttttgttgttgttgtttgtttttactaaaaggctagttttaaattggttatacttcactgcagctgacataacactttttaaaagcaatctggaagaggtgcggttgaaataacaattggaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattatatattaaaatagctttcttccactttgcaaatcatactttcccctaacgaacctgtcgacaggtctctaaattagaaagaattcagtggactttggtatatcttctttcttccagttccataggtactgaaagtgaaaaggggtgggaagcactgatctaaacctccctgtaccttagtcctatgagatcatgactagagtctgcctgtatgtttttcagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaatttgggttttgtactaaatgtattttaagactattagatatagggtattaatgaattctcttgaagttcaagccactagtgccattcatcaaatttaagtcatatgaggtatgttaggtgaaaggactcacttccagcatcacaattttgacgcctttttttttttttttttttttttttgagatggagtctcactctgtcatccaggc

SEQ ID NO: 3867 - DNA, 3270 bp, Homo sapiens
  Genbank Accession No. Z24725
  unsure (1)..(3270): n = a or c or g or t
caaaaagtgtgtggaaaggtggattgagggagcgggacccccgcgggacccgagggggcggcaggcggggaacggggagtcagcccgcgctgtgtctcggggccggccggcaggaaggagccatggctctggacgggataaggatgccagatggctgctacgcggacgggacgtgggaactgagtgtccatgtgacggacctgaaccgcgatatcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttatgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttnatttgtttttgtccttgaataagcatgttatgtatatngtctcgtgtttttatttttacaccatattgtattacacttttagtattcaccagcataancactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaaa

SEQ ID NO: 3868 - DNA, 1569 bp, Homo sapiens
  Genbank Accession No. Z24727
caaaatctcaaccatgatcttgagatggcaaaggttttaaatacgttttggaaatatactcattggtatatttcttttgagaaggctgaaatgtagctggggacagcaggttgatcacaagggacgatgatatgaggtaagcacacaagagctatggacaagacaaggtctaaaggattttgaatacaaagcagaaatatttcgaccttctcatttctggggtgggagtggggagtgttcattaagtacatatgacaagagggagtgtggggagaaggtgaaacagtagactacatttatggattaagtagggaatgtgaacaaagatgttaaagtcatggcgatccggtagacagattacacagaaggggaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtgctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaagcaagcccatgtcagggcgatcctggttcaaatgtgccatttcccgggttgatgctgccacactttgtagagagtttagcaacacagtgtgcttagtcagtgtaggaatcctcactaaagcagaagaagttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattttaggacattttctaaa

SEQ ID NO: 3869 - DNA, 7513 bp, Homo sapiens
  Genbank Accession No. Z25749
gaattcggatcccacagcttgtaagatgcagagccaggattcagacctaaacctgtatgtctccaggttctagtttactgcagagttggcctttaggatgttcatgaccatcaggtgaagacaataaagttacagatgctatgattagtgtttatgcaggctatagtaagggtataaaagtaacatatttaggaaaatgtttgagaagcctttggttttctttagagtacagcccatctttttgtatcttgagttttctacctgtaggtttgcacctcagttggtatgtgcattgggggatccaagacaaccctcaggtttaatcattcactagaaggactcaactgagaaaagcagctatactcacagttatgttacattatagtaaagaatactcaaagcggtaaggaaaaggtactgagttcagggcagagtccaagagagaccaggcacaagcttccagttgttctctgccagtggagttttatggacaacacttaattctgtcggcattggtgagtgacagtgcatatagaatattgtccaccagggaagttcatccacgtcttggtgtccagaattttgttgggggtcgattctgtagtcatggaacacctgcatgactgaccttagttaatcagtctttagcctccagaaatcaaactacatgatccagggccccaccatataacattgttagcctaaactatctggcgtggcccaatgtctggtaaacagccactcatatcaggcaggacattccaaaggcctagagatgatctcttagaagttggttgaaggccagctctttatttgaaatgtgcagggtttatttgaaatgcgcagggtttgaacatcaacactttaatgcacagtatcattgataaatctttaaaccacagggatcctggggctcttccgtgtctcagtctaatgtcattcgttccaggattcccgacttcttaaagcataaataatccctccccaccctctcattgtactgttatgtaagttattacaatatgtcattatatatttagtcatactgctttaggtaatgtcttctccactgaactgtaagctccatgaggcccgggggtcagtcggttttacttaataattagcacctagtacagtactagcatagaatgaaggcctcgcaattttttttaaatttatttttagacagggtcttgcgtgtcgcccaggctggagtgcagtggtgcaacctcggctcacggcagcctcgactttcggctccagcgatcctcccgggtcggctccggggtagctgggactgcaggcgcgcaccaccatgaatggctaatttttttttttttttttttgtagacaggggtttccccatgttgcccaggctggttcctgagctcaagtgacctcctgcctcggcctcccaaagtgctgggattacaggcgtgacgtcagcgcccagccaagttagccttttttaaacgtcctgtctccggaggttgccgaagttggttttcttcggcctccttctctctcccaggcccagggctgggacgaggccggttcccgcctgcaacctgcactgaagacgggaaccttgggagccggtaccggaacgctcggaaaccgcaccaaagtacgaatcctaggccggaaaagcgttaccaagacactcgtccccagagccgcttgctgggactctctagcctcctaccgcttctcagtgatgttccggtttggcccctcctccgcgccctgtttccgcctcttgcttcggacgccggattttgacgtgctctcgcgagatttgggtctcttcctaagccggggctcggcaaggtaggttggcggcctgctctccgacagaacttttcttcttgggttgaggaaaacgcccttttggagtcaggccctggaggggcgagccttgctcacagggtggggatacagccgattacccgccctgtgctttccgatggcttctgcggggcgagcggggcctggccggggggtgcgggcgggagggcgagccagcggcgcctgcagcccgggccgcgtaacgctgaccgctgtgccttcagttctcccaggagaaagccatgttcagttcgagcgccaagatcgtgaagcccaatggcgagaagccggacgagttcgagtccggcatctcccaggtgagagggtttccctggggtctggggtggggggaggcgccccgcccgggggggaggcggccgcgcgtgtgttgggcccggggtgctcggacgcgcgctcagggtcggtcctgctgttcgttgcttcttaggctcttctggagctggagatgaactcggacctcaaggctcagctcagggagctgaatattacggcagctaaggtaagctggcgctccctcggctgggagggaggttgccccgcgtctccccgcccagtggccgggagggttggacctgggttacggttgatgatgacttgcccccctggccgcctaacctgaactcaggttcggccgtgttgtttgggagtgataccgcccaggtgcgcggagtgggcttgcaggtaccctgcggcttaagctgtccacatgcgggcggtggagaaacgtggagtggggagggcctgggcatttggaccttatttgcccttacttagttatagatacggcaaagagctgtggggagctcaggatgagattctctctacccttagcccggagttgccgcaagtgggggtgcagaagtggtagtgattgcctcctggcctgaacagtctcccttcctggaataaggaaatgtgaaggttggagagagatgagaacatttccgaaggatgcatttatgattaactcaaaactagtattagtttgtagtgcagctacggtgttagtgataaggtcttcttatcctctaatttgaccacaacgtttactttctgaagcagttaacacagtggctttttgtttttttctttaggaaattgaagttggtggtggtcggaaagctatcataatctttgttcccgttcctcaactgaaatctttccagaaaatccaagtccgcctagtacgcgaattggagaaaaagttcagtgggaagcatgtcgtctttatcgctcaggtatctgttctactgttgcagcacgtttctgtttgtgaattttgctaaaattgcttgtatttagactgcattggtagttggagtcatgaaaacaatccttttatgaatccaattgggtagaaagataaagtacaggcagagcgccgtggctgaggcctgtaaccccagcacgggggggtggaggcgggtggatcactgtagagaccagcctgggcaacatggtaagaccctgtctacaaaaaatagaaaaaataagttttaaaaagaaagataaagtacgttctttaattaagagtcgaaacaagaagtctgtaaagtgacagactgctgtgttttgagttatgaaaatgatttcccatatttaaatttccacaagtctagtgggttgcttacatagatgatcaaactaagaaacctgttacaggccgggccctgtggctcactcctgtaatccccgccctttgggaggctgaggcaggcggatcacgaggtcaggagatcgagaccatcctggctgagtgggtgaaaccccgtctgtactaaaaaatacaaaaaattagctgggcgtggtggtgggcgcctgtagtcccagctactcgggaggctgaggcaggagaatcgcgtgaacccgggaggtggagcttgcagtgagccgagatccccgccactgaacttcagcctgggcgacagagcgagactccatctcaaaaaaagaagaaacctgttacagttcggatgggggattggtgcaaactgaagtctatcgggaatgaagtgccaggattgatgtctggaataaaagtagtattctgggtcataggcatgggaaaggcgcatctgggagattttgtccactggcgtattagtagtggctgtggattctgaatgatttattcaagaatcaggaagtaactccatagaagggtttgctcagtcaattgttcgtctaagttgtttagccttctcgaactttgaacttaccctgccattcttcttgcttttaaagcagtatggcagttacagctttttgtcaatttaaagtcttttttcattttgttacatgataatttttaccttacagaggagaattctgcctaagccaactcgaaaaagccgtacaaaaaataagcaaaagcgtcccaggaggtgagtattttagtagtttcagaaatgtgtgtacccctcttattaacaactcttaatttgtttaagttgtagtttatgaaaacagatgttcaagtgggaatttttgagtagcagcatttggtttcctgtatagttgcacatgatacgttttagaattctagatgtaaaacatacatgtattcatgtagccattgtttgcctactaggtcagtgctgtcacagatgagatgattcctcgattattggcacaggatttcctccgattatttgtgcacaggctcggaatgatgagaaggaaatcattactttaattctgtgatatagcatgctagacacagttgacatgggcttggatttatctttgatttttatttttgctgtggattggaggtaaaaaaatgtaggtggattttggtgataacatcacaggttaaaatatcactgcagttgaagatgactagatggaaatgtttatacttgattgacttacaggttatctggcataaatctcaatatgagtgtctctgacagtctttgtatttgttagtctctgattagtatgttgtttacaaatgtgaactattaaatccctgtggactcttccctaaggatgagttgaagaaaaaaaaaatcctagtgttgcctgtgccctctaacatgtttaatttgtattgttactctcagtggatgaggaaactgatccaaggctgggataatttgctgattgcagctagtactagtagtgctaagaatgttttttttttaactcggtcttgttctgaaaaccactagaacacagtgttggagtctaatgtgttattgtgtcgagctgtggtatgtggaaaggtaggtgccagcatttctagaacttgaattctatggcttagtactttgaaaaacttttaaaggcagagtggcataagaatttaggattttttggccctaaatcatgacacttaaagagggttttggaaactcagttctgagaacctcagttaggaaatgagtataagaacagtcccagaggactgtccctcaaatccatagctttagtttccctcagtacaaacctctgttttccaaattttctcagagaatggcttcagtgtttctagtgggactgtacattgaaagccttcacactaagcctagctggtaggtcatagtgattctaccacttttccaatccggcttcctgctttcagatttatttttccctattcagtagagctatctttatctaactcaggttaaatgctgaaattgatagtttttgggtatagcagggtttttcctctaaggccctccagtccctgtggtttgtgatgattgagttatggtgccattgctccccattttaaaagattgtagatgacattggaatctaatttccgtatttgggtgctttcctagtattgtaagaatatgcttaattaatgagtcgcaatgaataatccgtttgtcttgatttgctttctaaaggtgatgagggttttggaaatggactttgttcaggcttttgccctttgtggctgtgacatattaagatgttggcagtaaaattgagagccaccagaagatgttaactgtgtatatgggcgctgccagataggaaatccaaatgagtagactatagtgttattgttagctactatggggtgagacgtagacagataaccatatgtaaggcagctccctaaatgctgaaacaaagaaccgtctcttgacttactcctgatgtctcatggtacatggtagctgccccaaaagcttgcaattaatttgaaacttctcatttgttaggtggcaggtaggtaggttttgaacttggtagtgatattcagacgaggagcaagattccactggcagttctgtgatgctaagtaaatgatgtgatcatatccgtgctttagaaagattatcttgacattggaagggggtggttttggagatgagcaagagtgttaaaggttattgtagtgatttagttgagaaataatacaagtgaaaataaagatgtataaaagtcctctaatctcacattccctagagatggtcactcattgccttggtgagtttgtagtttatcccagagtaacatttaaaattgactgagcttttgaaataaatcagtaagctattaccctattctaggtaggcaaaggctttagtttggtacgtgaaatataacaagcttatttgaaaatgagtgttaatttgacttcaggaacctgggatttgcattttcattttgacttaaagaggtgccctctggagttgcccagagggggcgttgctaggtggcttaccttttaaactattcttttagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacatttatcatggaaaggttcagccacagtgagagtggattttagtgtaaccagtctccatgcgccaaccatagcaatgactgtagtaaactcagactagttcttttacccgcacttcagcctgctctcctttggattatgtgtcaggtgttaaatggagatgtttcaagaattgaacacttgaaattctctgtaccttttggaagtagactctttctgtggtcttttagttaggctgtatattcttggtagttaggggtgggtggtgatgggatcagtgtcttgggcccacataaccatgtgggtgactgctggggtacccctgatggcttccccggtgcagtggtgtacagttctgtcccacagcattggagaagagcttgtccccggtcgtgaagactgctgcagacatgttgtgtgtacttagttgctgaggagaaaaacaatacagggcaacaatttcacaaactattaggttttaagctgagtgtgtatttcaaagttctgtgatgaattctttcttttcttgtaggttgaaactttttctggtgtctataagaagctcacgggcaaggatgttaattttgaattcccagagtttcaattgtaaacaaaaatgactaaataaaaagtatatattcacagtactctgtttcagttatgtttttcaaaattccaaattcacggatgcgcagctgtcttcattatcagtggcgtcctgtgtgggccagaggatttcagtaggaggggtgtctgtgccagaaagctt

SEQ ID NO: 3870 - DNA, 3651 bp, Homo sapiens
  Genbank Accession No. Z26491
agtattgctgttcagatagcctttatttgggtatatattctacactgtttttaaatatggagagtaaccaaaatggcccattatctgaccacacaaatactagtagtcattatagataaaccatagcagataaataatagtaaacaaagcaacaggctgtgtcattggaaatccccaccatgaagaaaggagcaaggtgaaaacttctggctgcttcaggtcatgcatggtccctctccaccatcgttccccctgtcatcttcctgccagaataaggaccctggtaccttagggaagcaccatctcttgttttttccccacgagccctgtgggtcatggcacgtcctgccccgctgggaaaacacagtgggccacgggtttccctgcaggcctggacccttcccaagggtagcagcagaaggcagcacgattcccactcctgcagctgtgacagggcacccccactgtcactgagccctgcaccgggttccatcacctgctcggggctctgcctttggccttttcctgtgaactgcatgttggccactgtacctatctgtctctcatctttttttcttacgggtttgggtatgttcttggtaaaccagcccttggtcttacacatcatttccaaggtactaaggactcttcaggggaaatacaacttgagcagagtggttccctcctcttgtggttcacaaggtgcaggtgcacacacacataccacagggcagtgtgacaggaccagagactgcccctggggtccctggctgggggacactagtagggatgtcccttgcctctctgaggccttctgctgtctcttctgaggccggaaaggcgaagcactgccctcgccctgctagggaaggctcaggccaggctggccctatccggggaaggggctcaggtatctggaccttggtcatcgccaggttagggtttatgttgatgattatccaaaggcaaaattgatttccacagaaataacatctgctttgctgccgagccagaggagaccccagacccctcccgcagccagagggctggagcctgctcagaggtgctttgaaggtgagttggccaacggaagccggggcagtgccagggtgggacagaagaggcacacacctgctctgtctacccgagggcaccagagggcacgagaaggctggctccctggcgctgacacgtcaggcaactgaggcacaaggctggcatttctgaaccttgcccctctgcgaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggttggggttccgggccagcaggtgctcagctctgggacagggacccaggaccaggcatcaaatcccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggcgggcatgcgcactttgatcctccccaccaggtgttcacaccacgttcactgaaaacccactatcaccagggtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggctggctgggtggcctgttgggaactggggagccaagcggtccctgtcctcacggggcccatgttctgaaggtggcacccaagtcttgtacagtcctttcctgcaggagtcacgctgggcaggaagtggaaacctggccccaggggctaggcacaggcagtggtgccgtggcctagtgaggagcacccatcctggtttggggcaggttctctgggcacctctgacctctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccaagcattcacacctttctgaccaagcaggcgctggggacaggtggacccgcagcagcaccagccc

SEQ ID NO: 3871 - DNA, 372 bp, Homo sapiens
  Genbank Accession No. Z26876
tttttttttttttttttttttatggggtgtgataggtgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcct

SEQ ID NO: 3872 - DNA, 2694 bp, Homo sapiens
  Genbank Accession No. Z28339
ccctaggacacctttctaaaaagactccctgtggtgttcagaatcactcctacagtcaggttctccacaatggatctcagtgctgcaagtcaccgcatacctctaagtgatggaaacagcattcccatcatcggacttggtacctactcagaacctaaatcgacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaagctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggcgatggaagcttgcaaagacgctggcttggtgaaatccctgggagtgtccaattttaaccgcaggcagctggagctcatcctgaacaagccaggactcaaacacaagccagtcagcaaccaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcagatctttgacttttctctcactgaagaagaaatgaaggacattgaagccttgaataaaaatgtccgctttgtagaattgctcatgtggcgcgatcatcctgaatacccatttcatgatgaatactgactgccgggagttcctgaacagatttttcactcccatgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttcacaggacaacgaagtgcatgtggcagtgtgctggcagtggccttgaggctttggaccattggttacaaaacagacacagccaagataagatccacacacacattattaacaaggaagtgatttgctgcaccttgagttgagaggactacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagtccggcctgggtgaaagagcgagactccgtctcaaaaacaaaaaaaaaaaagaaaagaaatatattttattcattcacattaggtcactgtcatactgtcataggctgagagagttcttcaaaaattatgttttcccaagatcagttgcttatagataatgttcaatgacctcaagacatatatttttgagaaattatcattttaaaaaatttggtctatactgattgttttcactgattccaatattattacttataacactgacctctggaaaatattttgttcacaagaaataataaagtataatgatttgttgcatc

SEQ ID NO: 3873 - DNA, 852 bp, Homo sapiens
  Genbank Accession No. Z28407
tctctctctctctctctctctctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcca

SEQ ID NO: 3874 - DNA, 1247 bp, Homo sapiens
  Genbank Accession No. Z29481
cgcgggaggacagcgctgcgaggaggcgcccgggacagtcatggagcgccgcctgggagtgagggcctgggtgaaggagaaccggggctccttccagcccccggtctgcaacaagctcatgcaccaggagcagctcaaagtcatgttcgtcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggttggccaagcaccctcgagtgccatccctgccaaacaactctcccagcccccactacctctctgtgtactgccgctgtgtcccccacagacctgcacattgttgtcacccaccctcctgcccttctcagcccagatgccatgccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgc

SEQ ID NO: 3875 - DNA, 1450 bp, Homo sapiens
  Genbank Accession No. Z30425
gtgagcttgctccttaagttacaggaactctccttataatagacacttcattttcctagtccatccctcatgaaaaatgactgaccactgctgggcagcaggagggatgataatcctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaaaac

SEQ ID NO: 3876 - DNA, 2139 bp, Homo sapiens
  Genbank Accession No. Z30643
ggggaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgagcacaccagtggctgtacagggagattggggacagccacctgctccggtatctttcctggactgtgtaccctgtggccctcgtctctttctcctcaggcttctcccagagcatcacgccctcctctggaggttctggaatcccggagctgaagaccatgttggcgggtgtgatcttggaggactacctggatatcaagaactttggggccaaggtggtgggcctctcctgcaccctggccaccggcagcaccctgttcctgggcaaagtgggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactagcaagcctgtgtactccgctctggccaccttgcttctcgcctccatcacctacccgcctggtgtgggccacttcctagcttctcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcaggggctgcagccttctcaggggctgtgacccacaccatctccacggcgctgctggcctttgagctgaccggccagatagtgcatgcactgcccgtgctgatggcggtgctggcagccaacgccattgcacagagctgccagccctccttctatgatggcaccatcattgtcaagaagctgccatacctgccacggattctgggccgcaacatcggctcccaccatgtgagggtggagcacttcatgaaccacagcatcaccacactggccaaggacacgccgctggaggaggtggtcaaggttgtgacctccacagacgtgaccgagtatcccctggtggagagcacagagtcccagatcctggtaggcatcgtgcagagggcccagctggtgcaggccctccaggctgagcctccttccagggctccaggacaccagcagtgtctccaggacatcttggccaggggctgccccacggaaccagtgaccctgacgctattctcagagaccaccttgcaccaggcacaaaacctctttaagctgttgaaccttcagtccctcttcgtgacatcgcggggcagagctgtgggctgcgtgtcctgggtggagatgaagaaagcaatttccaacctgacaaatccgccagctccaaagtgagccggcccagcaagatgaaacagggcaccccagctgacctggtactgaggccg

SEQ ID NO: 3877 - DNA, 1556 bp, Homo sapiens
  Genbank Accession No. Z31357
cggtcagatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccatcgagtgggcaatgtacgccaagttcgaccagtacaggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaaatattggaagataattttgtgaatctgtagattttattttttcagtcttaccttacaaatttcttttctatgaataatagaggaactcacggcactctgccacttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacac

SEQ ID NO: 3878 - DNA, 2481 bp, Homo sapiens
  Genbank Accession No. Z31690
ggcacgagagcggcccggcaggacagctccagaatgaaaatgcggttcttggggttggtggtctgtttggttctctggaccctgcattctgaggggtctagagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttata

SEQ ID NO: 3879 - DNA, 2300 bp, Homo sapiens
  Genbank Accession No. Z37987
cagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaataaaaaaaaaaaaaaaaaaaaaaaaaaaaaaaaaaaaaaaaaaaaaaaaaaaaaaaaaaaaaaaaaaaaaaaaaaa

SEQ ID NO: 3880 - DNA, 228 bp, Homo sapiens
  Genbank Accession No. Z38150
cagactttaaatgttttattttgttgattctgtacaccgtcagaaacaaggttagaagtaaaataaagtgccagttaaattcggctactaccaacaaccaaaaccttaaacatagaaaatcaaagtaaactgcggaaaggtcatagcataaccttgggtaaaggaatttgttaacgtctgtaacaaatcgaaactgactacgtatgtagctcttcaactgcaagacgg

SEQ ID NO: 3881 - DNA, 234 bp, Homo sapiens
  Genbank Accession No. Z38161
  unsure (1)..(234): n = a or c or g or t
gatcttccaaaaatttattaagtgtttacttttaaagtggaaacaatgttttnaagaggtgatataaagaaatgcccccactgtaatccctaccatatgttgattctatgtggtgggagggaggggagaatgattcctttttctagaatcagagaatttggaaagtatcaagaaagataataacagaaagcatgaaatagagttgtgctttgaagatgaattggatgaaattgt

SEQ ID NO: 3882 - DNA, 172 bp, Homo sapiens
  Genbank Accession No. Z38192
  unsure (1)..(172): n = a or c or g or t
acagtgatttcaaacagtttaatgtaattccaagacaaagtgtgattacatttctacacatatacaatatgcatatgtgagtttacaaattttaattaataagtcatttcacctcggagaccgaaaaantgntcaaaaagaaactntgngtaacangctataacatagttca

SEQ ID NO: 3883 - DNA, 260 bp, Homo sapiens
  Genbank Accession No. Z38266
aaaccacaaatacgtttattcctctaaaaacagtataccatctttccaattttcaaaatgttattatcaattgtctgcagattactctcattaagctgatttttaaaaatctcagacagagcagagcaattcaccagcaccatcatcaagtgagctacaaatctatcttttaccagagcaaggagacacttaagatcaattcaagagaatagctttcagtgttcacagaaggggtactcacattcatttgtcacatattt

SEQ ID NO: 3884 - DNA, 273 bp, Homo sapiens
  Genbank Accession No. Z38299
acgttttgtatgtttttttatttgctccaggtggggttttgactgtcactttcccacactctggattagttctgatcccaccacaaggagccctcgaattggctaaagtgagaaactgggcctgaagactccgtaccctctgccatcttgccgagggagtctccttttagaaaacaatcaaagggttattgcatgagtctggatgaatcccactctcagctgtccacgggcccgaccacctcatctagccccctttttggcagggagaacctg

SEQ ID NO: 3885 - DNA, 277 bp, Homo sapiens
  Genbank Accession No. Z38404
ggctgttgcttgttttattttttgtccaagagaggtggtgttggaccgaggtagagaagacagtggtacaccagaaataacccaaaggattgccccttctgtagaaggcccttagactccatgatgcctttcagctgggtgctatacttgcacctaactctgggggcttcactttctatccctacaattactcaaacagataaaaggctggatgttaacatgtagttataaggggcgtgatctaatagtaaggaatatcacttcccacaagtccttc

SEQ ID NO: 3886 - DNA, 177 bp, Homo sapiens
  Genbank Accession No. Z38431
cttgttaaagaaaaccagtttattctaaaaagctctaaatgccctgtgcttggtccctggtcagggagaggtctcaagaggttactacctgcacaggggctgaaggtacagggggaaagtcaggtttcagttggttgagtcctaccttatctgtttgttaggctttttctagaaagt

SEQ ID NO: 3887 - DNA, 257 bp, Homo sapiens
  Genbank Accession No. Z38435
  unsure (1)..(257): n = a or c or g or t
ctaaaactacctttattgtggttggctcgacataagatgccgccatcagcagaattataaaactgtacaggaggcacaaaaataggctgtttaacttagataatgaccctcatgtcttcaagctttaaaaatgcacataaaagttgtacaatctggcagtttataaaatataangctaaaaagaggattttgggttccacaaagaagactgtatcacacaattaacacgtactaattaaacaattaaccatccacac

SEQ ID NO: 3888 - DNA, 276 bp, Homo sapiens
  Genbank Accession No. Z38444
  unsure (1)..(276): n = a or c or g or t
agggaaaagtatatttactagacttccataatccatacttactttaaattcaatctagaaataacatgactcatattaggcaatatactttgaagatctgtacaacatagtaatcacagcagggtcttgctaactcacaaatttagcatacatgctgcaaaaacatctctcctggngtcccaagggctttcaaatgttccaccaggggcagtcaagactagattcacggtgctctcttcatcatgcgcacaaaatgtgttttcccataacaccata

SEQ ID NO: 3889 - DNA, 222 bp, Homo sapiens
  Genbank Accession No. Z38462
  unsure (1)..(222): n = a or c or g or t
gtcaataaataattccactttaatggcaaagtaataatttagacagatacagggtgcacatttgcaaaaaaatatatgcaagctggtttacaagctagaggnacaataaaccaatagaaaatacatcatccagttaagtccattgacaccaagtacttattgttggggctttacaaagactacaaaacttttcagatgatttatttcactgtttctgcctat

SEQ ID NO: 3890 - DNA, 268 bp, Homo sapiens
  Genbank Accession No. Z38688
aaaattaaatttctctttattcaattgcctctgagtagtgctgtgatttccaagtgccaggtagttaggtgtacaaatatacataccacagaaacatacagtttttaaaaaaattaagaaactggctgcatctgacgacatcaagaaaaaagataattctgattcaagggcttctccagaagatggggtttcattggcatgacgctcataggatgacctgtcatttttgtactattttttctagaaccatagagggatgacagtaact

SEQ ID NO: 3891 - DNA, 273 bp, Homo sapiens
  Genbank Accession No. Z38729
  unsure (1)..(273): n = a or c or g or t
gtatgttgtttcatttaattcttaaataatcctttacagactcagagaggtgaagagagtagcacaggtagtatcagaattgggattcaaacctgacacatacactgagcactaagttaaaaccgggcactgggcagctgctgaggatgcgatggtgagtacancagactgcttgctctttttgatatctagaatcttacagctctgcttgctcatccttgtctgttgtcatttactagttgacatcttcgttgactacctagaagcagctgc

SEQ ID NO: 3892 - DNA, 293 bp, Homo sapiens
  Genbank Accession No. Z38777
ataaaacacaattactttattgatttcttacaataaaatactgccaactagcattacgtccactcttgcatcattaaaaacaaagggtatttcctccttggtattttcaaatgatgcattatacaataaacgaagttagaacttaaaatgcaccctgattaattatgtaaactggtaatttgttttaaaaagcataataatttggttcctttcttcataaaatggaaatttaaatatttcttctgatagtcttgaggttatcattatgagtagtgcaaagtgtggcacatata

SEQ ID NO: 3893 - DNA, 238 bp, Homo sapiens
  Genbank Accession No. Z38904
  unsure (1)..(238): n = a or c or g or t
ggcatttaatgcactagatgctcttatctttttaaaaacataagaaaatgtcagaagattaataatactacagatgttgccaaggaacaagactgacctaaaattacaaaagtataaaacacaaaaatataacatgctacaagggaaaattagtacataagtacacttaaaaaattttncaataaataaagattgcactgtaattggcatttaaagtactgtatgcagaatataatat

SEQ ID NO: 3894 - DNA, 289 bp, Homo sapiens
  Genbank Accession No. Z38909
ctttaacttcaatagaagagtagataaaactaaaaacccttattgtctccaagtgtgtggcaaaatagaaaatctttcaattacattaggaaatcgggtggataacggagtatagttattccacttaagaagcattccagtcaaataatcacaaaaacaaattcagattgcttggatcttggtcatttatggcttgaagaactggatttgaaaaccactttaggctaaaataaatgtatatgaataatgcatagactgtgtatctagaaaatcatgcaataaatatatg

SEQ ID NO: 3895 - DNA, 285 bp, Homo sapiens
  Genbank Accession No. Z38910
  unsure (1)..(285): n = a or c or g or t
aaagttctgattggctactgtaaaggcaatcttagaagatgcatgtaaatataatataaatcaactttcttatcaattagacattttccccactcacatctcttagtttttagggtattcagtcccagcaaccaaaaaaaaaaatgtaaatcatattttgtttctggctaatgttcaatcagttttncttttataagagcttttgatgtactgtttctacggttctttaggcacttacacataaaaacattcagagggttttccccttaacacacaacttttaat

SEQ ID NO: 3896 - DNA, 292 bp, Homo sapiens
  Genbank Accession No. Z39059
ccaggtcaacacgcttttattgccacttctggctcccctcgtcccagcaagattcctacctcttaccctgtaggaatactgagctccgatgcaggggaatggggtgggggtgttaccacttctcctctgcacactgccaagttaaagaaaaccctgcttgctggagagggagggccagacagggaggaattcaagggcatgtatggctcagtcccacttctgactgcagagtatagggaccagggttccaaacttttttcgaagtaagggaggtggggaagaatttggctgc

SEQ ID NO: 3897 - DNA, 299 bp, Homo sapiens
  Genbank Accession No. Z39079
  unsure (1)..(299): n = a or c or g or t
aatggtcagcaatgtctttttaatacagatgtggtacagaatgtttaattacagcagggcagtgattccagttaaataaaattaaaaacctttattttcccaaatataaaattactaaattaaagtcttaaaagaaaatataacatggtgacagctttaaagtacaccaccattcaccacaggntttatgatttaccaattacatactccaccattttggcaaaaggatgaaattcttaaaactgtttataaacctaatatagtaaagactgtatacatctccatattgcacattttta

SEQ ID NO: 3898 - DNA, 312 bp, Homo sapiens
  Genbank Accession No. Z39191
  unsure (1)..(312): n = a or c or g or t
gaaaacaaaataaatttattcgtcctcctccacataacattttccctgaaggagagtgtccctggcacctggcccagcttccacaatggaatggataggccccttccctccttttactccctaattggcccaaagcttttgaacagaccctcaaaccaagcagaggaagccatggtgtgccttccaccactggagggttacatttgaaattggtgtcccaattttaaaacgtcccagctgccataggagaggctcttgggagtggcctccagntcttgacaagggcccacagaggccactgccccatcacgg

SEQ ID NO: 3899 - DNA, 174 bp, Homo sapiens
  Genbank Accession No. Z39200
gtatgagtctgtgatgtatcaagtgctccaactactcaaggtagcgcagaagggaaaacaggcacaggccggggggttttgggtgattacacaaatgggcttggcctccttaccccactgcaaactgctgaggcgcaagggagctcccagccctcagcctggaccctgggaccg

SEQ ID NO: 3900 - DNA, 256 bp, Homo sapiens
  Genbank Accession No. Z39379
cctgatggtggaaatcattttattctcatacacaggttattacagcacaattaggaagagacaatcacaactcacacaatgctatattcaaattatgccaaagtcccaacatattcatttcatttgcaagttaattcctaaaagatcagagcagagtgatacacaagtttattaacacagactacaacgtcaatgaagcctcctggcattgtcggaaatagaaaacatgtataaaaatcttcgaaatgcaggttaa

SEQ ID NO: 3901 - DNA, 307 bp, Homo sapiens
  Genbank Accession No. Z39394
  unsure (1)..(307): n = a or c or g or t
gacacttccttaaatacatgtttattttacttcaatatcgctcagggttgtatgtatttgaatacttcagtactattttgaacattctaaatatgaaataccataaagcgttcaaatttatcaaacagtggtacaatatggttactaaacttgcaacttaatttacaatgacgttcaattttncctcttcaaataaaatcactgactttggtccatttgatgagaaactaggacatatgccatgacagcatacttctagcactctatgtaataagcaaaagataatttagctaatatagacaggtta

SEQ ID NO: 3902 - DNA, 312 bp, Homo sapiens
  Genbank Accession No. Z39406
  unsure (1)..(312): n = a or c or g or t
acactgcaaaaaggtcatctatttacagaagagtgatttaaagacattatggttttctttacagatgtaagancagcaactgttcactttttaaaaactctacatctcaaccctccactattattatagtccactgaattgcctgtatcaaaggcagttttttgtttgtttttttcccatttgactctccaaatgaacttccatcatttcttcatcatctgtgggctggctctcctgaaaagtctcagggaataagtcacaggagggcaggtttttgacctgctactaaaaattaaaccacaaaaactagag

SEQ ID NO: 3903 - DNA, 352 bp, Homo sapiens
  Genbank Accession No. Z39429
accaaaagaaatctttattcttcagcaggtagacaacatctgccaaccctggtcctcagggccacactcatatgcactcacccctcagcagcatatcgccccttttctgacatataaatgcaagagacccaggaccctagatctttcttcaaacgcaagtgttctcacacacacttattttacaaatccactagaaatatggactcttatgttctttgtacagccatgcaacagaggcctagcatttgtgctgtgtctgtgggaaaggcagtcagagaccagtggtttccctgctttggggaagatggctcaacagttagtaatcccaggttagattgtcagaacagtctag

SEQ ID NO: 3904 - DNA, 258 bp, Homo sapiens
  Genbank Accession No. Z39431
  unsure (1)..(258): n = a or c or g or t
acaaatnatttcctttattccccctgcctcccaatttccaggtagctctacaaagacattcagacagagccacatgcaggctgtccttcaaacacagagaaacaaaactgagccactggctggagatcacatntgcccaaaggtggacttttctcattcaatgccactgggcagctggccaaagaaaaaaaaactgaccaagcggaaggtttgaacaggttggggtggggactcagaagggggtgcccccacatccat

SEQ ID NO: 3905 - DNA, 347 bp, Homo sapiens
  Genbank Accession No. Z39476
  unsure (1)..(347): n = a or c or g or t
gctttccagcttttatgaaaattaataacattaatagctcacagacatatacatacacacacattgctatgtacacagtcattaagttattaattaggctctgtaaaaaaaaggtttctacattagtgttccgggctaggcccantcagtccttggcatattcacagtggcagccccagggcttggccccacaggcaggcagaggggaggcaggaggccacagagcagccggccccacagtgagcacagcaagtgtcctgggccacctccttgagtcttcagttcccttcctagcacctgcagtccagctgctcagcaagccggcagacaggtcctgatcccttctg

SEQ ID NO: 3906 - DNA, 228 bp, Homo sapiens
  Genbank Accession No. Z39569
  unsure (1)..(228): n = a or c or g or t
ggtgtcacatccatttattgtccatgaggctacagctccattctnagggccaggaatgggcaagcctgcccagtgtgccattcctgcctcccagctctttccctggnggcctaccatggtgccagcctggagctctgcctgtcctactgggaccgagcagacagccccttggcccaccattcgtaacacagggacttggctggcctcaccccantggcggggtctcct

SEQ ID NO: 3907 - DNA, 296 bp, Homo sapiens
  Genbank Accession No. Z39622
  unsure (1)..(296): n = a or c or g or t
aacagaaagaaaaaagttcctggacaccagacccacatatggtatttacaaatttggtgtgaaccctgcctctggttctgcccagagctgaagagtgaatctattacagagatcagagctgtcaggataattatcaagtgcagtaaaaaatagcattttgaaaaaaatatatacctttagtattgcctttctagaattaactataagcaagaaaaacttattttttaaagangaaaagaatacttttncactcttacttataagagctggttgtagcagcactactaaagctagtt

SEQ ID NO: 3908 - DNA, 322 bp, Homo sapiens
  Genbank Accession No. Z39682
cagatacaaagcagtatttatacatttatttatatatgtatatttacttcagaagaaacgaacatttcggggacaggaagcaagcaggcccggggctgcttccctcactgcccacctcagagtcagagttggcacatgacaaataccaagctcagggagaagaactgggagttaactgggaagtagggggcgctctatgcacacgcaggcttctaagggtgcacggtatgggcaggaggatttgcactgggaggccctatgtacagcttgaagctagggggagattagcccagtgactacaggaacaaacgccaaaggagag

SEQ ID NO: 3909 - DNA, 335 bp, Homo sapiens
  Genbank Accession No. Z39818
gggttcaagtggtctttattagatccacataagaatctagaaaatgataaaatatcacaaaacacagcacaatgtgggttcaccaataatgaaatatagagagaggatcttatgttttaaatttttgtaacatatagtccaaaacaaatagataattatacattctgcaatagatgaggacattggcagggcatataaaattagactcttgggcttcaaatgactaagttggaagcattagcaaactcaaggaagggacaattcagaggctataatgggcttaatgctgctatttaaagtaatgaagcattttctctgctttctggattcatttc

SEQ ID NO: 3910 - DNA, 342 bp, Homo sapiens
  Genbank Accession No. Z39833
  unsure (1)..(342): n = a or c or g or t
ctttatatgtattatattttnnattaataaataggttttcttcattaaacacagaacatataacagattgaaacactccccccctccccccaattccaaagacaagagtctataaaacaaatgccagctgtactaccctaagggcagaaaaagtctggtgacccccacccagccctgcccctgcagcaccaccacccccacactctgcaagagaagggggtctggggcttctcccttggaccctggggacttaggtgagaagcatgtgaatgtatgatgtcacctctccatgaggcatgggctatgcaaagatgaggtttccttctcattggctctgaccag

SEQ ID NO: 3911 - DNA, 302 bp, Homo sapiens
  Genbank Accession No. Z39930
ggtgcagacaaggcagctttattgtactttgggggagaaaaacatgattccatttacggggaaaaaagccattgacactcagtaagcaacactgccatctagtggaatggtgacacaccaccaagaatttcaagacccgataggaaatgtgagtggatttggtttcaattttcaccacaaaacagcacttttaataagctggttttcagagaacttcagatttttttgagaaactactttttatctttaaaatgcataaatgtatgtgttttctctgttttgggggggtggttaagaatgag

SEQ ID NO: 3912 - DNA, 273 bp, Homo sapiens
  Genbank Accession No. Z39976
  unsure (1)..(273): n = a or c or g or t
acatgaacaacataagtatttatttgaaaaacattttccatttaagtaaaatggcaaattagctagagtagcttcttactgctaattctatttgcactcacagtcacttttattcatcatattcaaagatattgctaccaaaaatgatttcacaaagtatttagaaaaaatatatacagtctctctaatagaaagttaattaaaacaacaaagctaggcaatatcaagctaagaaaggnaaccaattgacatatataaccacaaataaataaa

SEQ ID NO: 3913 - DNA, 289 bp, Homo sapiens
  Genbank Accession No. Z39978
  unsure (1)..(289): n = a or c or g or t
ctgcacattccagttttggcttttatttaacattgactatacaatactctggtactaccacatgtttacaacccagaaagatgtacttttatgttagtgtctgtaaagagggatttaaaatgtgtattttaaacacagcagttgagctgagtgcatttnctatagtacgctgaggtgttacctattctatttcaaataaattctcaattcccagccactgaatcataaatgcaataaaaaaaatcaacagaaatgangaacttaataaaacatgttgtccaaaaaaata

SEQ ID NO: 3914 - DNA, 223 bp, Homo sapiens
  Genbank Accession No. Z40006
gagtgtattaaaggatgtttatttagaaaagaaaaattagctttgacaagagacacctgcacatttgtgtagccaaggagatgtcagtgagagcagaaggtgaatccttcatggagactgaacacaggtggccagctgtggcagcgacagtgaacacatgtcagtgtcggcctgggggcagagtggttgaatgctttaagtctggtggagagcctgccttgct

SEQ ID NO: 3915 - DNA, 310 bp, Homo sapiens
  Genbank Accession No. Z40192
gctggtcaaggcagagtttactgaactgttagtttcctcctgcacacaccgggcatgacaccttcaagtctgtccagcagtgggtccagaaagtaccctgtgtgccttggacgcagaggctacagttctcactgtgtggcatgggagccttcacagtgccctcgggagctgcccctggtctttgtctgcaaaggtgactgggaggatagaaaaagcagcgggctggcattgtttcgggggtggggtggtgggcagtgtgcctgggcagtcgcagggaggttgacttggttctgggctgcaagatctgtgc

SEQ ID NO: 3916 - DNA, 297 bp, Homo sapiens
  Genbank Accession No. Z40259
atagcaaataataaatttattaggtgcctacaagtacaaaatactgaaagccgctgcaggggattataaagatgtgtaagagacaagccctgccctcaaagagcttacaatctaggcaattagtcacacaaataagttgtgatggcgctctaagtgacctcagcagagttcttgaaaatgttcatatccttcaaattcttctcttgtcaaattaaacagtgggaaagagaacttttgtggcattcactggtgaccctgactctgcttgcaagcatctttctgctgttgcacgttgtc

SEQ ID NO: 3917 - DNA, 341 bp, Homo sapiens
  Genbank Accession No. Z40305
cagaggtatatccatttattgtgggcaagacaggttatgggagggagagaagaggaggcctggctagcaaaggtgatcttaatatgtaaatgaaaccttacaggcagcagctctcagaaagaataagctctaaaagtttctttcagacctttacagctgtcagactctcagttaatctttcctagatctgggcaaggaaagacttggctgcatcaatgcagattccctacagatgcaaatctcctcaacgaaagacaactttgcagggctacttctgcagctggctttctgaacagacatctcaaaatatgtcaaagaaatgtattttggggtaaaatatt

SEQ ID NO: 3918 - DNA, 346 bp, Homo sapiens
  Genbank Accession No. Z40556
  unsure (1)..(346): n = a or c or g or t
gagaatacaagaaccttttattttccatccagttgggcagcagggaaaggctaggtgggcccagcctgcccttccttcctccagctggctggatttattatnagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcatg

SEQ ID NO: 3919 - DNA, 276 bp, Homo sapiens
  Genbank Accession No. Z40583
  unsure (1)..(276): n = a or c or g or t
ctctgtaaaagcatttcctctgaatattttattcagaaaaaaaacacaaaaagataagacagaaacaaaaatcccagtcatctgcagtatctgtcggctttcaatttggttctcttttttaaataaagaaaaatagtaaaattaatctatgtaaaacatgccatatatattcaactgctactaaatataaaangctttaaaactgtgtgttcaattttggttattgtattaccacaacacttatattaaaacatgtatacttttaaattgggtttc

SEQ ID NO: 3920 - DNA, 292 bp, Homo sapiens
  Genbank Accession No. Z40715
aaaattccttattttatttcaaaaaatgtaggggtggggaagtaacatgataaacattacgatcagctccctatgggttcattctgcctctgcgggggtcgggggcatacagtagctggggggcatgccattgccatggcaacccagatgcttagatgcaggtccctcctggctgcttagagctggggggactaggcgccctccccgaaagcccccattctgagttgttggtgcctgcccttcccctgaatctaagaactgattagtgggttagactgcaacagcagctcag

SEQ ID NO: 3921 - DNA, 324 bp, Homo sapiens
  Genbank Accession No. Z40883
aatccaaacgcacttctctttattcaaaccagggtcaaactggtcaatgggaaacgccctgaagccacgtgcctggggagaaaggcttcctactcggttcggttcagcgctgcgtgggatccacgggctggctgtgcgcaacccccacagttcacctcagacactaccaagcaggtcagtcgacaaaagcaaggaattaaacaaaaaacagaaatacactcagtagatttcttctagaagctcccagagtttctggaccaccaagtcccaacccccaaagccaggagcgaggggactaacagcgcaccccctccaccagtgccg

SEQ ID NO: 3922 - DNA, 270 bp, Homo sapiens
  Genbank Accession No. Z40898
ggtcgttatgctgcatttattatgagaatcaacagtcaacagttaatgattgactaactcttgttgttcactctggacattaacgaaaaagactggaatagggctacagcgctgcttttatgctacacgggttatgcttggactctgactcccagcagcaggtagattcaggaattcatggcagtgacattcaccatcatgggaaacaccttcccttttcttcaggattctctgtagtggaagagagcacccagtgttgggctgaaaaca

SEQ ID NO: 3923 - DNA, 314 bp, Homo sapiens
  Genbank Accession No. Z40902
  unsure (1)..(314): n = a or c or g or t
gtctgtcctccagcccagtttctttgggcttcagggttgtgcgaaaatnactgctacaaggggtagaaattgacagggagacactgagggggccaggcctgctataggagaaggtgttatttcggggtgcctgcccccagctgtttcatcttctcttctgaggctttgtctggaagcaggacctccacagtgaaattgaccttcttggcatgaatgaagctgtaggtgttgtcaaaccgcagacatagatgccaggatcactgcaggtgagggtcccatcttcagggaccaggtgggagttgtacctctggttg

SEQ ID NO: 3924 - DNA, 277 bp, Homo sapiens
  Genbank Accession No. Z40945
  unsure (1)..(277): n = a or c or g or t
atttaagtncttttttattttcctccacactggcaaaagttccgagggagcctaaagttttgtaaacattttaactatccctcttacccacccccaacttttgantttacaaagcaaaggagagtaggagccccaatttttaatggtttcctctcccctcatgctatttgatccaaaaactatatacaattttgtagcagtctctgtatagttattacacatgtttagaagggagggaggcaagaagggatagggagaatggtgatccaaaataata

SEQ ID NO: 3925 - DNA, 236 bp, Homo sapiens
  Genbank Accession No. Z41042
  unsure (1)..(236): n = a or c or g or t
ctctatccctcgatatttaatgtgtatttnctaaaaacaaggacacattcttacgtattcttattagaacaatcaccaaaatgaggaaattgacattgatatgatactatcaggcaatacagtacagaccagttgtcttaataatgtcctttagagcagaagaaaatccctgggcaggcagtgtgctcagctgccacttctctttaggtcagaggagtgcctttaggatggtgaca

SEQ ID NO: 3926 - DNA, 235 bp, Homo sapiens
  Genbank Accession No. Z41103
  unsure (1)..(235): n = a or c or g or t
gaaggtctactctttattgcccttgtacacaaaggaagggggtgtttggttccaggtagtgagagaggagcaccccttcaaggctggtcgaggaggcatgtcccaaaggaagagttcaaggcggtttccagagaggaaggaacagccagggccttgcctcaacatgggaacggatttnggcctccacttntaggactccagaaacagaaagggctgtttnacggagctggggacg

SEQ ID NO: 3927 - DNA, 193 bp, Homo sapiens
  Genbank Accession No. Z41271
aaacaccacacatacacaaagcattttaaaggagccacatatatctatatagcaactctgactgcttttcaaagttaccagggaaaggaacttattcaggctttctttaaaaaaactccttagttttaatgtatatctttttaagattgatgctgtcatttgaagtaaaataatgtcatatggataatggggg

SEQ ID NO: 3928 - DNA, 173 bp, Homo sapiens
  Genbank Accession No. Z41349
  unsure (1)..(173): n = a or c or g or t
ggcaggtttccttttattggttctagacagtttgtggaaggaagagatgaggccatctagaggccggcagntcgcccagtgccccaaacactgccaccctgaagtagtgttggaagctgctccagggatgttgcagccctaagcacagtgacaggtgggggcaggagcagcag

SEQ ID NO: 3929 - DNA, 272 bp, Homo sapiens
  Genbank Accession No. Z41356
  unsure (1)..(272): n = a or c or g or t
gctttaaatcccgtatttattgcccaaagctcattagtattacacaaatcacatagattgagaaattttctgaggttaaaaagacgctgcaaaggcccctgggagtggctgaggcttgcntgcgggggcctcactctcactgggccaggcttgaagaccaccctgggtctgtccaccagcctttttcctcctctaggctcctgcccttttcccaggccagaggcagtaacaccaaagaagtcggctcataaccaggtgaaaggggtccgtcg

SEQ ID NO: 3930 - DNA, 237 bp, Homo sapiens
  Genbank Accession No. Z41415
caggtacaatgtatattttaatatgggatttgtgtagtgatttagagcataaatatcacacagtgaaaaatttatcacaaactaaatacagtaacaaaaggaaagaaagagcttatgtccacatttccaaggtctttacaataagttatagcgtccaggtccaacacagcatatttgcatacaaagccactgatgtgaacactgaaaggaatctgtcctgtaggtctttcatcttga

SEQ ID NO: 3931 - DNA, 293 bp, Homo sapiens
  Genbank Accession No. Z41634
  unsure (1)..(293): n = a or c or g or t
gcaagtaaagattacttttaattataaactggccataaacccaaatgaggatatagtcattgtagagcaaaatgatacaatgcacccaacccgatatttacattaaaatatttccagtcacattaactttcaaacaaaaagacttaacgaatttacaaatttttccaagacgtgagangtgaaaaatgtttttgaatgccatctgagcaggatagtaaaatcactagantagtctttttaagttctcagttactggactgaaaagataaagctgatgaaaattggtgaacaat

SEQ ID NO: 3932 - DNA, 242 bp, Homo sapiens
  Genbank Accession No. Z41740
aaactttaaaattttttattcaacaatgtacacttattgtctctcaatttgatctacaaatttctcaagttttttttctgataaaataagtaaatctgggtatggttgtagagtgtttgtaatttatatttttaaaacactgaacatgatgaagacatcaataaaggaagatcatcacgtaaatgacacttcctcagaatccatgacatcagaaacagctatagcaaatacctaagcattta

SEQ ID NO: 3933 - DNA, 283 bp, Homo sapiens
  Genbank Accession No. Z41747
ggttagcatttttattcccagcttttttgtggtataatgcgcagaaggtaatgaacacattctacctgcaagcttcttcctgtgcctttggaatctgctcctgccagtctgcagggaaccacggatctgctttccgtcacgtaggaggcattctcgacaccctctgtacacagcatgcgctttatttggcttctcttacgcagcgtagtgactttcagatttattcaagctgctgcgtgcgccaacagtccactccttcctagtgctgaggcccccatcacat

SEQ ID NO: 3934 - DNA, 288 bp, Homo sapiens
  Genbank Accession No. Z41798
cacggtggcattctgggtttgggttttattggctttccattgagaaaggtggccagtgggcatcaagggtgccataaaggcccacagagctttgacctggggaccctgcttgttttccagaagtgacccaccaggagaggtggaccagagagctctctgcctggagggctgtggctggggagcacgaccggatgatgcagagctggaggaaggcgtgggtaagtggccgcagccgggcaaagaaaggagggctggagccaggggcagggcacctcaacaatccagtgg

SEQ ID NO: 3935 - DNA, 3923 bp, Homo sapiens
  Genbank Accession No. Z46629
cggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgacgatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatgatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttttccaattttaccttctttaaaataggttgttggagctttcctcaaagggtatggtcatctgttgttaaattatgttcttaactgtaaccagtttttttttatttatctctttaatcttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctacatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctctttttttttttgtatattattgtttacaataaatatacattgcattaaaaagaaa

SEQ ID NO: 3936 - DNA, 2326 bp, Homo sapiens
  Genbank Accession No. Z47553
ccagatcgcagctgaaggatctgttgagcgcttcaggaaaggcggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatacccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaactca

SEQ ID NO: 3937 - DNA, 341 bp, Homo sapiens
  Genbank Accession No. Z47727
ggatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggag

SEQ ID NO: 3938 - DNA, 3161 bp, Homo sapiens
  Genbank Accession No. Z48054
gccccctcttctcccctcccccaagccagcacctggtcgcccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagatttttttttttaaactaccatggtcccaggattccatcctgaaatttatttttctttgtatgaatatgtgtaaatgatttaaaaataaaactgtaaaatatttgtacgaagaataaatggaactgatgtgggaaaaaaaaaa

SEQ ID NO: 3939 - DNA, 4797 bp, Homo sapiens
  Genbank Accession No. Z48199
  unsure (1)..(4797): n = a or c or g or t
cctgggaccaaagtgctgcccagagctgagggtcctggagccacatgagaaggcttctccctgtgtacctgtgcagcacagggtagggtgagtccactcagctgtctaggagaggacccaggagcagcagagacncgccaagcctttactcataccatattctgatccttttccagcaaattgtggctactaatttgccccctgaagatcaagatggctctggggatgactctgacaacttctccggctcaggtgcaggtgaggttgtcatgggggccccccccacccaagacggcaacaggtcatgcctgggggcagtggtcaggcagtctcctgtgtttactgagcatgtactgagtgcaccctgcctgccctgtctccacccagctggctccaaagggcaatgctgaggagaggaatggggtcgtgagctgctgttaaggagagctcatgcttggaggtgaggtgaaggctgtgagctccagaaggccccagggcgcnctgctgcacgcaggctcatattcactaggaatagctttactcactaagaaacctctggaacccccttcagaaggttatttgactcctgagcctctattttctcatctgcaaaatgggaataataccttgacctgataagcttgtggagctgtaaggcagcacagagccagctggggtgtagctcttccatccaagctcccttccttacttcccctttcctgtggggactgggggagagaagtccctgagctggaggtggtcagggaagcttcacagaggaggtggctcttgagtggacctcaggaagaggggtgagagagctaaggaaggaggctgaggtcatccctggggaagtgacctagcggaggcctgagagctgcaaggtaggatatctgttgttggaagtgtctgttgttggaagtgggggcctttttttcagggagggtggggccagagaagtgtgtgccctgggataagtaggataaccacagtagttatgcccctaagggatgcccaccccacccctgtggtcacagaaaagctttcccaggtggcctaggcacctgtctcgtggctccagagacaggctgcacctgacacacacaatggaaggacagctctccttgtccattttccaaggagcttagcctcagctgccttgtccaggtactagcctccctcatagcctgagcttggccagcccaggtgctctggagcctcccccgacccacccaacacactctgcttctggtcctccccaccccccacctccccaacacactctgcttctggtcctgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggtgagtggcctctgcattccttgggaaattgagtgggttggtcctaatgcctggcacttggcaggccctacacctgtgccctgcgcgatctcgtattcctcaccaggaagacagggcacaggggccgccttcccctacccccagggcctcgcagagcaggacagactaactatgagatcagagcagaagcacccttaaagatcacccaagagagggctcccaaactcacaatccaaacttgcagccctcgtcgaagagtgaacgttataccagtcattttatttatagcttcgtggatttacgcttacactaaatagtctgctattcatacaaaatgtgtgctttgtatcactttttgtgatatccatgccatggtccagccagggtccggagttgatgtggcaagaaggcctggctttcgggccctgtgcgatcctggtttgggtgcatctgagtgggtggtggcaaagatcagggaggcaggagctgcttctgggtctgtagtggagctggttgctgctgctggcggtgacctggccaacccaatctgcccctgccctcccacaggacttcacctttgaaacctcgggggagaatacggctgtagtggccgtggagcctgaccgccggaaccagtccccagtggatcagggggccacgggggcctcacagggcctcctggacaggaaagaggtgctgggaggtgagttttctttcaggggggtagtttggggtgaattgctgctgtggggtcagggtggggctgaccacagccaaggccactgctttgggagggtctgcacgagagcccaaggagccgctgagctgagctggccccgtctacctgccctaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtgggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtcactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagacttttttttttttttttaaactaggagaaccaaatctggaagccaaaatgtaggcttagtttgtgtgttgtctcttgagtttgtcgctcatgtgtgcaacagggtatggactatctgtctggtggccccgttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcaggctcacgcccgtcctcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagcccatcttctaaatggcaaaggaaggtggatggccccagcacagcttgacctgaggctgtggtcacagcggaggtgtggagccgaggcctaccccncagacaccttggacatcctcctcccacccggctgcagaggccagannccagcccagggtcctgcacttacttgcttatttgacaacgtttcagcgactccgttggccactccgagagtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtncccaagccagaggtgggttcatttgtgtaacgacaataaacggtacttgtcatttcgggcaacggctgctgtggtggtggttgagtctcttcttggcct

SEQ ID NO: 3940 - DNA, 2194 bp, Homo sapiens
  Genbank Accession No. Z48475
gtgaccagaggggtttgtgtggctgaagaggcaggaggaacagtgtatccacagcgtgggaccatgccaggcacaaaacggtttcaacatgtcattgagaccccggagcctggcaagtgggagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccagagactctacagcgaatccattctgaccaccatggtacaggtggctgggaaagttcaggaagtgctgaaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtctgtggtggcctctagggaggggacagaagatagtgccttgcacgggattgaggaactgaagaaggtggctgccgggaagaagagagtgattgtcattggcatttctgtgggactctctgctccctttgtggcaggccagatggactgctgcatgaacaacacagctgtcttcttgccagtcctggttggcttcaatccagtgagcatggccagaaatgaccccattgaagactggagttcaacattccgacaagtagcagagcggatgcagaaaatgcaggagaaacagaaagcttttgtgctcaatcctgccatcgggcccgagggtctcagcggctcctcccggatgaaaggtggaagtgccaccaagattctgctggaaaccctgttattagcagcccataagactgtggaccagggcattgcagcatctcaaagatgcctcctggaaatcttgcggacatttgagcgagctcatcaggtgacctacagccaaagccccaagattgccaccctgatgaagagtgtcagcaccagtctggagaagaaaggccacgtgtacctggttggctggcagaccctgggtatcattgccatcatggatggagtagagtgcatccacacctttggtgctgatttccgagatgtccgtggctttctcattggtgatcacagtgacatgtttaaccagaaggctgagctcaccaaccagggtccccagttcaccttctcccaggaggacttcccgacttccatccttccctctctcacggaaatcgatactgtggtcttcattttcaccctggatgacaacctcacggaggtgcagactatagtggagcaggtgaaagagaagaccaaccacatccaggccctggcacacagcaccgtgggtcagaccttgccgatccctctgaagaagctctttccctccatcatcagcatcacatggccactgcttttctttgaatatgaagggaacttcatccagaagttccagcgtgagctaagcaccaaatgggtgctgaatacagtgagtacaggtgctcatgtgcttcttggtaagatcctacaaaaccacatgttggaccttcggattagcaactccaagctcttctggcgggcgctggccatgctgcagcggttctctggacagtccaaggctcgatgcatcgagagcctcctccgagcgatccactttccccagccactgtcagatgatattcgggctgctcccatctcctgccgtgtccaggttgcacatgagaaggaacaggtgatacccatcgccttgctgagcctcctattccggtgctcgatcactgaggctcaggcacacctggctgcagctccttctgtctgtgaggctgtcaggagtgctcttgctgggccaggtcagaagcgcactgcggaccccctcgagatcctagagcctgacgttcagtgaacccatgtttctgggtgggtgaaaggggcccaaccctgcccacttcagcccagcccgcccaaggggacttgtgccagcagaacatgtgggaggaagaagccccgtttccagggcatccgcagcccagggtagggagaaatattctctccactttgggggagagttcttgctctcgacctagtggtttctactctcaccgacttattctgatttcagaaataaaatgaaatgtcttattttggaaaaaaaaaaa

SEQ ID NO: 3941 - DNA, 2093 bp, Homo sapiens
  Genbank Accession No. Z48633
gccccatgcaagtccaaaacccagcaggcaaatcttagagctccaaaatgacctcctttgactccatgtgtcacatctaggtgatgcaagaagtgggttcccagggtcttgggcagccccgcccctgtggctttgcagggtacggcccccccttctggctgcattgagtgtctgcagcttttccaggcacacagtgcaagctgtcagtggatctaccattctggggtctggaggatggtggcccctttgtgacagctctgcttggcagtaccccagtggggactctgtgtgggggctccaaccccatatttccctttgacactgccctagcagaggttatccatgaggcccccccgctcccgtgcacagcaaacttttgcctggatttccaggcattttcatacatcttctgaaatctaggcggaggttcatgaacgttaattcttcggtgcatctgcaggcttaacaccacctagaacctgaaaggcttggaacttgcaccctctgaagccatggcctgaggtgtaccttggccccttttacctgtggcaggagcagctgggatgcagggcaccaggttcctaggctgcacacagcagggggttccggactcacaagagcatttttccttctaagcctcctggcctgtgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaacttttatgctctgcttcttctcgaatgctttgctgcttagaaatttcttctgtcagataccttaaatcatctctctcaagttcaaagttccacagatctctagggaactctagaaaaaaattcttattttgactctttcccgcctatcttatgcccgtttctaatacaggtgcacagtgcctgcagtgtctttgcatagtaagagtgactttactccatttcccaacaaattcctcatctccctctgagaccacctccgcctggaccttattgtccatatcactattaacattttggtcaaagccattcaacaagtctctaggaagttccaaactttcccacattttcctatcctcttctgagccttccaaactgttccagcctctccctgttacccatttccaaagttgcttccacattttcgggtatctttacagcagcagcccactctactggtatcaacttattgtattagtctgttctcacactgcaaataaagacatacctgagactgggtaatttataaaggaaagaggttgaattgactcacagttctgcatggctggggaggcctcacaatcatggtggaaggcaaggaggtgcaaaagcatgtctcacatagtggcaaggcaggagagagcatgtgcaggggagctcccatttataaaaccatcagatctcatgagacttagtcactaccacgagaacagtatggggggaaccatccccatgattcagttatctgcacctggccccacccttgacacgtgggaattattccaatgcaaggtgagatttgggtggggacccatccaaactatgtcagtatgttttgacttctggcttgattgctaggttgcatagaggacaaacatggaaattaatgaagtaccttaatatctggcttcagatcttagacaggatcagagggccagctcaaatttgcaaggaggggaggtagatcccaccattttatgggtgaatggcaaaatcaaacagaaattatgtgggatgggagatactgatgcaggcatctttggaaacattctacttagctaattttatgctaggctttaggtcaagaaggagagagagagctgacatgctgtggtacacacttattgtcccagcgacttggaaagctgaggcaggaggattgcttgatcccaggagtttgaggtagtgtgcgatgatcgttcttgtgaatagccactagccactgaactccagcttgggcaacattgagacaccctgtctcttaatttaaaaaaaaa

SEQ ID NO: 3942 - DNA, 4037 bp, Homo sapiens
  Genbank Accession No. Z49269
gagctccgttgggagtcccatgtttctttatggcataatgggtgagaacacagacttggaagccaaaccacctgaatttgaaccccagttccatttaccaactgtcaaaagcttaggctttgattctaagcctgtttcctcaactgctgttctaaagattaaataggctaatattcataaggcaactgggacagtggcttgtgtgtatagcaaccattatataagtgaattatctactgagcaccacagcacttcttcactccatggtgtggtgaccagaatggagatgagacagagaactgcaggttctgcttcgagtttaagttaggatttcccttgaccaatgagacctgacttggaggagtcctggcctcattccattaccccaaacaccctctagtctctagatgaacagatcctgaatgtccaggccccacgtggcctgttctaaggcctgagatggaattggatacaggacacatccagccttgagatcttttgctaagtgtgacacagtgcccccagccctgtgctcatgttcatgcctagggaaaggcttctatcaaaagagttgaacttcttcccactggggatggaagaccatttcctcccttaaaccttggctctccctgcttccttcaggccaccaacaacacatgtgcaggatatgaaattgctgaggcatcactgctttcctacttcccttccaagtctcagctcccttattttaaaaaatatttggcctcaatgatcatttctcaacaattcctcaccgcaggagcctctgaagctcccaccaggccagctctcctcccacaacagcttcccacagcatgaagatctccgtggctgccattcccttcttcctcctcatcaccatcgccctagggaccaagactgaatcctcctcacgtgagtgcaatgccttgtcttccttccaacctagagcctgcagggaaataagcaggagtgaggttggggctcaggggaagaccaggagcagggactcagaaaggagggctggtatcttcttgaaattgtgtgtatagcaacattatataaatgaattatctactgagcaccacagcacttcaccccatggtgtggtgagcaggatggagatgagacttaggactgtaggttctgcttaagagtttaagttgggatcttccagccttgaccaatgagacttgacttgggagactccaggcttcattccactaccccaaatgccctctagtctccaaataaacagatcctgaatctccaggcctcacatggccttgatctcttatcattgccccccaggaccagtccccccttgccctcaaggacatggagtgagaccagcctgcctctctactccctcaatttctctctctttgccgctaagcaaaagagtggcccaccccatttggggtatatttcctcagggagattaggagcagtgtcttgagcccctcaagggcatttttctattggcctcctgaggtttgggcccagcctgcttccagcgtcacctgtgcccagtgagtgcagcattgcttgggtatgggctggggggaaacacgacagtgtggggtccatcctaggcccccttttctcagctgatttcttagaataagctgcctttagagataaccaaaactatttatcactcttccattttacctactctccttttcagaaactggggggaaaccgaaggttgttaaaatacagctaaagttggtgggtatgtgcacagtttgacttgccctctccgatgtcatttgtcagctcagaggaacaaggtgggagagtataggagctctgactgggtctcaggaaacaggggccccttatgccgttctttggatcgtgaggatgctgcctggaatggagctggaaaacaggatgagacccttccacccagacatctggccaccctcagtgacctctgaggccattgtgatgcacatccatgattctatgaagcagggtcacataacatgcacacacctgatttctccactccataaccacaacatgtgcctgtttgtacagggctcttggcctacaatgtccttcctgctacctctataattcaagcttggggtggctgctgtcaccttgcttctcctataaaagccatgaaacttctcaatcagaaaatagatgaaaaaatcacccaatccagtgatttttaaaactttttagaccacaaaaccttttcttcaagcaatatcttccacagaggcccaatatgtaaaacagaaaaaatgggttgagtagggtacaagacaccactctcaaatgcagcaaggcctccacaatagtccctgaggcccccagagctcagtgtaaaaaccactgatgcagtccaagggcctcatttacagaggagggaacagggggaaagtaaaatggccacagtacacaggaagcacaggcaaggttaggttaggatttgggtgccctgactctgtggcctttgtccttggggcttgctgtgggcatcctgctctctctgcaggttgtcggttcaatggggacatgggcagggtggagcactaggaggggctgggtttgcattcccaaatggcatgtctccaaatccctattgggatttcttccaaatattcctcctatttggagcacctttcccgaataaggcatgaaggctgcatgatattggccaagtccctagccttctctgccagtcggcccccagagatggtgtaagaagatctgagtgtgctgctcttcaatcctggagttgaaagtcatccaccagtctttccaagaggggttgaagaaaaggaggaagggtgattgatgatgagggaggagaaaaagaagagcccaggagtaccatggagaaggagaagagaagatgaggaaagcctactctcccctccaagttctgaggggctgtctcctccttccttccctcctccatgccctcagcttgcaggagcagccaatggtatggcctttaacaaggggcccctcctcagcatctgatgctctctcctcagggggaccttaccacccctcagagtgctgcttcacctacactacctacaagatcccgcgtcagcggattatggattactatgagaccaacagccagtgctccaagcccggaattgtgtaggtggtacacacacatcacactggggggagagggagccagcagggcctcctggagggaagcagggagtggtggtggaatggggacccccagcgtacctcccaggtgtgactacatggggagaggcagctgaggggcaatctgagcgctttctggctggagcctgcaggagccatggggaaactgaccccatggatggggagatgacagagaagggagaagaaggcaagagggcacttcctcagggggacacagagactagatgggtctaggggtcctaggaaccgaagagtatgtctcagagaggagactggctctaagctgcctctgtggaagaaaggaaaagcagtataggtcaggtggggaatttaggagggagggaagatgggctgtctcttccggccactgggcccctcggtttgtgatccttctccctcttgctccacagcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttccctggcctcattcctttctacgggatttactcattggccatgcactgaggacaccagggtgtggcaccctcggcatcaagcctcgctctgcagaagttttggtggagcctggtacaaaaaataggtcaggcctgcaatgcaggtagtgagaagcagaaagtgagaaagaaaagcagtgtaaagaccgtctcctcctcagcagcaacagtagcagaccccg

SEQ ID NO: 3943 - DNA, 993 bp, Homo sapiens
  Genbank Accession No. Z49878
cggcggcgcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggagacgcaggtgcccgcgctgctggaggccggcttccggagggagaacatccgtacggaggtgatggcgctggtcccaccggccgactgccgctactacgccttcccacagatgatcacgcccctggtgaccaaaggctgagcccccaccccggcccggccacacccatgccctccgccgtgccttcctggccgggagtccagggtgtcgcaccagccctgggctgatcccagctgtgtgtcaccagaagctttcccggcttctctgtgaggggtcccaccagcccagggctgatcccagctgtgtgtcaccagcagctttcccagcttgctctgtgagggtcactgctgcccactgcagggtgccctgaggtgaagccg

SEQ ID NO: 3944 - DNA, 3490 bp, Homo sapiens
  Genbank Accession No. Z68228
cgccagagtccggagcagccgccgcccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctccggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacag

SEQ ID NO: 3945 - DNA, 20556 bp, Homo sapiens
  Genbank Accession No. Z69923
gatctgggggccccagtatggaaacaggctcagggctgtgacctcctgcccggcaggacctgagtgtgagggtctgtcccacactgacaccctttctgctcctcctagaaccgtacggagtccccagaacctaatgccacagcgacccctgcgatccccactatcctggtgacctctgtgacctctgagaccccagcaacaagtgctccagaggcagagggaccccaaagtggggggctcccgcccccgcccagggcagttccctcgagcagtagcccccaggcccaaggtgggtcaggtgggcctgggaggaggtgtcgtgcttcaccttagggctgggtgggaggagcatggctgcggctggaggtcctgaggggctcgggtgcccctcgagggagccctgaccctgccaccccctccccacagcactcaccgaggacgggaggccctgcaggttccccttccgctacgggggccgcatgctgcatgcctgcacttcggagggcagtgcacacaggaagtggtgggtccgggcagccggggcacccgagctggggtcacctgccccacgctgcctgcttttctgggagccgggcacacagtaggcgctcaccacgcagcaggcggacccagtgaacccagagaccctccagggtggtggggtggggtgggggcctctgcctgggacccccatgcacgcaggtgtcgccccccaggtgtgccacaactcacaactacgaccgggacagggcctggggctactgtgtggaggccaccccgcctccagggggcccaggtgggtgctgggttgggtagcctggggcgggcagggggcactgggccaggccagaagggccaaggggaggatggggcggacccgggcaggggtcctggctggaggggagcagaagaggagctctgggattaaccccggtgggtgccacttagggccagagcctctcccaggtgggacctgcgtctcatggtggctgcgcggccatcgctggggccaaggcgccgcctggtggtgaggccgggccctgcagccacacaggcgtgccccaggcaggggacaggtgggcagggtctgtggggtgcggtgccagccgccctgctcacatgggtcctgggacacatgggaggggtctgctgcctgacagtgtgggtgtcaggcttccaggaagccacgtgcacagctgggccagtggcccaggtgttgagtgggggacgctgggaggaaggggaggtctgtgcccctcccagggaccttgcaccccgaggggcgtagagagggcccctttgctctcagagcccctcactggggcctgatggacgccttagcaagcagagaatgtcacagagggaccctgagcctcccagtccgcccctcacaccccctcccgcatgtccccagctgccctggatccctgtgcctccggcccctgcctcaatggaggctcctgctccaatacccaggacccccagtcctatcactgcagctgcccccgggccttcaccggcaaggactgcggcacaggtgagctgggcctcggaggtccgcaggggtccaggggccggagcaagtccccggaggatgggagaacaggtggctcccgagtgcagggcaggggccctgcacggggacagcaggtggcagggtgtgagggcttactgtgcacccctcagagaaatgctttgatgagacccgctacgagtacctggaggggggcgaccgctgggcccgcgtgcgccagggccacgtggaacagtgcgagtgcttcgggggccggacctggtgcgaaggcacccgacatacaggtgcgccacggggtgtgagccgtgccactgacccctgacgggtgtccctgtccacacccgagtgggaggaatggcctgaggtcacccagaaacaagggacaaggggtggaccccggccccgactccgctgtcgtggggcactgcgcggcccctggcccagctcctcggccctgcccccagcttgtctgagcagcccttgcctgaacgggggcacctgccacctgatcgtggccaccgggaccaccgtgtgtgcctgcccaccaggcttcgctggacggctctgcaacatcggtgagtgggtcagccccccggggtgccctggggcagtgccgggtggacccaccgtgggccggcctcactgcccctctgcccgcagagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggtcagcaccacgccgctccaggccgccgcatgcggggcaggcaggatttgtcctggggagaggccccccggctccctaggacccaggcggggccagctccgtccagacaggccccggaacctctgcctgggaggctgcccgagggagggccactctcttcccactgctccaggtgcggggaaccgccctgctgggggttccgatgccccctccccatgccctcttcgaggggcagtgtgactccctgccagcccccacttatgcaccgcaggaatccggacaatgacgagaggccctggtgctacgtggtgaaggacagcgcgctctcctgggagtactgccgcctggaggcctgcggtgcgcggctggcggggggtgctgccttgggccccaccgaggtcacagcagttttccccgtgatcctcctagcccctccgcacacctggctactgcatctctgacaaatggggaaactggagctcacgggatcaggctggtccaaggtcacgcagtgggtcggtactggggtcacagtggggaagcagcccgctgcagggggctggtcaccaggcgacggcctcggggtggcacctgcccagcctggaccatgcccaggatggccgcagaagcctttcagggaggtgcagggagggcagcgtgcaggccccccagaggccacctgcttcctgccctggggagaggccccccggctccctaggaccccggcggggccagcccggggctctcatgtgggggtctctgactgtgctggggctggctgtggggttccgggctgctgagggggccacaaaggcctccgtgtgtccagcccctctggccctcacagagcctcgggatcgggcatcaaaccccattctacagatttggaaactgagggcagaggtgagtgggcgccagggcctgagcagcgtggacagggggtccgccatggccctctgcagcgcctcctgccgggtagggcctgtgtgtggaagggggctggccctgtgaaccccaggggtgtgacccggtgacctttgctcccagaatccctcaccagagtccaactgtcaccggatctcctggcgaccctgcctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctcccacaggtgcacctcctctgggccccagtcacctgccctgaggccccacacaccatccagcgtcactatgcgcctgtccccacccgcttgcggaccccatcccggtgcctctgctgaccccttcccggggtccccggtaaccctctctgacccctctgggtcttggggctcagtcctgagctgggcatgcatggacactccagaaaccctgtccctattgagggaggccaggggtcagtggcatttccacagaggacccagcgcctgcggagagtgcagtgggccaggtcctgtcctccccgcaggccccgcccctcccagagtcctggctctcagtagggagccagggagcgcagtgacaatgcgtcagagccctaggagcccaagcacagccagggaaactgaggcccagcccactcagccggctcccctcagtgggggcgcacagccacccaggcccacactctgggaggcgggcctcgagtggggagaccctgagacggagcagcctgggccagacgcccttccaccttcgatgggcaccccagtgattaggggcaggggtccggccagccgagggtctggcggcctttcgaggaccacagctcccagggtggggtcctgcgtggccctgcagaacctgcagccggcggctcctgggcctgcaaatggggccagagccttcctcagtgtggagaaatggggttccccacatggagcccagggcaggaggccgaggcagggtggagcgacctccacacagcagatgggagccaggctcaggggcccaggctctgtgcccagcaggagtgagggctgcatctggggaccccacaatgtggatggaagctggggcagggcctgagcaggccaggtctccacccactcgggtcggccttgcagccgatcctgcctgggcttggcctgagactccccccagggcttgtgaccagtgttgtcaggagggatggcaccgcacttcagctcccatgcctggatctgggggtgactggcaatagcccctgcttggtggtccctgtctccccagtatcaacagcccacacccaggcacctgctcagacccctccccgggaccagggtcccacaccattggcctccgtgggcctgacagggggtggggagaggtgagcccggtggctgggggagggctggtccatgcagcctccagccccccttgcacagcccccccagggacagcgtctccgtggtgctgggccagcacttcttcaaccgcacgacggacgtgacgcagaccttcggcatcgagaagtacatcccgtacaccctgtactcggtgttcaaccccagcgaccacgacctcggtgagctccggcgtgtcgtggctgcactctgggcaggtgggccctgtgctccccaggccaggcccagacaggggcaggagctgggcagacatgtggtgcgggggaagctgggggcagggcagggaggacagggcaccgctcccttctggatctcccaggctgccctgtggaccccactggctaccctccctccaccacgggccccgacagcctcccgttcagcccgcacaccacaggctgaccctggccactcttctgatcagtcctgatccggctgaagaagaaaggggaccgctgtgccacacgctcgcagttcgtgcagcccatctgcctgcccgagcccggcagcaccttccccgcaggacacaagtgccagattgcgggctggggccacttggatgagagtgagttgggaggggggcgcccagcgccccgccagggtggacagtggccagccacagtgtgggtgtcacgctgagggcattgtgtcccacagacgtgagcggctactccagctccctgcgggaggccctggtccccctggtcgccgaccacaagtgcagcagccctgaggtctacggcgccgacatcagccccaacatgctctgtgccggctacttcgactgcaagtccgacgcctgccaggtgagctggtgcccgccccaccaggacccgactggtgggggctcagctggtcctgagtctccgagatgcttgcccctggggagcccagagcctggcggcaccccaacctggcagggccagccagggacccctgggcagggagcacacttactgtcggtggccagcaccccagggccacccagagccctgccggaagggcatcctcctcacacagaaggggagacccaggctctgagaggggcctggggtcccacagagcccggacagttcctggctgtccagcccaaggcagtgctttccgtgtgacactaggcaccaaaggcccctttgccccgagttctctcaagccagctcttcaaccttcaataagttcttcaaccttcaataagcccaacagcccaaccacgtcctgggctctgcaggcctgtgtgctcaggcggcacggcaaccctggcatgcgacggctctcttatgccccattttatagctggggagactgagccccaggcagtcaattcactcttccaaggccacaaagcccaggagtggtagagtgggtagggcttgtcactggacctcgataagggaagtcaggatggtttcctggaggagggagtgtttgcactggtcctgagtgatgcgtaggagttttccagggagtgaagaagtcatttcaggaggtgctgggacacagggtggctgtgtggtccacacagggttcatgctggtggggagagggggaccgtggcttcaggaaggggaataacgtggttggatgccctggcccagccagtgctgcccccagggaatgagacaccttttcatgaggttcaggagagtggatcagctcccttgctcagaaatgcctttgtcctctgtccccaagctgccacttgggggagaggggggtccctgaaccaggcccctgggagggtggctctgaccaacgtctctgcccagggggactcaggggggcccctggcctgcgagaagaacggcgtggcttacctctacggcatcatcagctggggtgacggctgcgggcggctccacaagccgggggtctacacccgcgtggccaactatgtggactggatcaacgaccagatacggcctcccaggcggcttgtggctccctcctgaccctccagcgggacaccctggttcccaccattccctgccttgctgacaataaagatatttccaagaacccggcccacgctgcctggcccctgcctgcgggcccgccttcccctccaggccatgactggggcccaggtctatgcgcagcaggcctcaggctgccgttctggagcgcacacagtcctcagtggagacggagcctgtggccccacagcggggtctggccccacggcccagagagttgtcaggggatgaggtctgggcctctccaggccccagcagagtccagccccctcccaggccagccccaggccggggctcagcacctgggttgtcccagggcaggaagtggaaaccaagtccaggcccccaggcgtggaggggtccgatccgcgtggtgcacggagtattgaacctgaagaagaaagagcggccccacgggaacacccgcaggccgtcgttggtcttccagatggcagcccgcctgcctgagcctgggctgcacttcccgggagggaggaggccacaggctgcctctgtgggggctgagggagggaggggcccatgtgctagatggggcccagttagagggtcactgctgggcaggcagaggccgtaccctccctccagccagggaggacaggagacagggggaggtggggccagagggcagagagggcgggagtgtggctggtgggggtcaggcctcctccctgcttcgaggcacccaggaccttctctcctgcgccccacctccttcctggcgtcctggtctcggggaggcagtggtttgcagttacagctgttcccttttgtcgggagccccttccccagcagattggcgccgcccaggctgtacggaggctgggagggcaggaaatggggcattggggccacacagttaccgccccaagcaaagccgggttctgagcaaagagggaagagagacatggccaggcccttctccccacggcccctgctgctgtgcatgggcctcagagccttcgagctcacggaacgaacttgccactgaagacccctgcccctgccacagtgttggtgcagcctgggcagtggctgggggactgagtctggcacctgtgccccaggatcctgagagtggagccgctcttcctcctgagtgtgggggcctccagcagctggttctggggctctgaacctcatggcttcagccccacttcacccacatccgatgtgagccgtccctgacccttccgccatgagcggtgagcattttcacatgcttcctcagcctctgttgagataaatgtacacattttccctttggcttcactaacatgatgacttccatgataggtttccttcctccctccctccctccctcccttcttccttccttcctccctcccttcttccttctttccttccttttcttccttcctttcttcttctttctctctctctttttctctcttttttcttttttcttcttctttctttcttctttctctctctctctctctttctttcttttcttcattttttttctttctttctgagacagggtctcactctgccacccagcctggagtgcagtggcgcgatcttggcttaccacaacctctgcctcccaggctcaagtgattcttctgcctcatcctcccgagtagctgggattacaggtgcctgccaccacgcccggctaatttttgtatttttagtagagatggggtttcaccacgttgcccaggctggtcttgaactcctgacttcaaatgatccgcccaactcggccacccaaagtgctgggattacaggcgtgagtcactgcgcccggcacatgataggttttctaactcaggttggccttgtattcctcgagtggacggtattgagctgaagtgtgagctggggtcttccctttgcccctcccacttgtgccctgcttgttcccgtcgtgctctgccgcgggaggctggcctctctggtctgcaatgggctgtgcactctcttgtttcttgttgggctattgggagatcagaggcaggggagagagactgggcatgtattttcctggctccctttctttggggtcagtcacctcagtgtttcaggtggaattatgtccttctagaattcatatgatgactgggcgcagtggctcacacctgtcatcccagcactttgggaggcccaggtgggaattcaagaccagcctgggcaacaggatgaaacccagtctctacaaaaaaattagccgggcatggtggcatgcacctgtagtctcagctactcaggaggctgaaggggaaggatcacctccaccaggaggtggaggttgcagtgagccatgatcacgccactgcactccagcctgggtacagagcaggatcctgttttaataaattaattaattcatatgttgaagtcctaacccctaatagcccagcatgtgactgtatttggagatagaatgtttaaaaaggcaatcaagttcaaattaggttattaggatgggcactaactcaatatgactggtgtcctaatgagaagagaaaatttggactatccacctgaaataatcaaaaggatcagaatccagtttaaaagagcatatgcaggcacgaagctgaaaatagccactcaggacacacagactccagaggattagagccagtaccccaaagccaaaaagtgaaggtcttgcttatacaggcagaaaataaacaaattgaacagggttacagtgcttcccatgcaaggctggtttatgagtcacagcaatttgattaatcacagcttgttttcttttccttttccaatttgaaagagcctattgaacgttctgtcttagacaacgtggtggccagtgaggtctctgtgtaagagaagtcagaggggagcaaatctacagtgaagatcaacatgaagagggaaggggtcttccctggtgtcctgtagtcttttataacattttacagaacaatgtaggtaaagaaaaagctaatctataatcagaggaacaaaggttacagctgcctaagctacagctgaccgtcatacgcaactcaggtcctataatcatgttccttgaagatgcaaaataatttaaagttccaacaactttggttttgaatggcttctttttacaggacgcagacatgtacagtaggaaggcgatgggagacacctggagagaagatggccgtccacaaaccagggccagaggcctagagcaggtgccccctgctggactccaagggagccaagcctgctgccccctgggttttggacttctggcttccagaactgcaaggtgataagcttctcttgtcgaaggcacccaatctgtggcagtttattatggtccccgtagcaaacaaataccctcaggttggctgcatcctgggactgaaggtcagcgctgctctcaagatgtaaaagactttctccttctgaggctccggggtccactcctgccattgccagcattctagaactggtgtggcccctccaccttaaccagccctgggctctggagtttctgactgtgattgtccacattttgaccacaactttgtatataaaaaccctccttgaactgttgcactgtgtgtgcccgcctattgggaccctgactgatacatgctgtattggtttttaaaaactttttaaaatttatattttatttaggattttgcatgtatgtttatgagattggcctataattttcctttcctatattctctgaatgactgttatcaaggctatcccagcctcataaaataagttcttcttttatcaaaattcactggaaaattctgtatatagttggaaggatctatcctttgaaagttaaatggaattcacccataaaattacctgtcttggtgttttctttacaggattgtatttaactactgattcaatgtctttaatagttatgggactagttttatttcttcttgagtcagttacaggaagttatgcttttataaatttatctgtcacccaggtgtggtggcttatgcctgtaatgccagcactttgggaggccgaggcgggtggatcacaaggttaggagtttgagaccagcctggccaacatggtgaaaccccatctctactaaaaatacaaaaattagctgggtgtggtggcaggtgtctgtaatcccagctactcaggaggctgaggcaagagaattgcttgaacctgggaggtggagattgcagcgggctgagatcctgtcactgcattccaggctgggtgacaaagcaagactctgtctcacagaaaaaaaaaattcatctgtctaattttttatattcattgacacaaagttgttcctggttgtgatggttaatatgaagtgtcaacttgactgggtcgaaggatataaattattgtttctgagtgtatctgggtgtttctgggtgttgccagaagagattaacaattgagtcagtggactggggagaggaagacccactctcgggaagttccactgtgatgtttaatactgagtgtcaacttgattggattgaagcatacaaagtattgatccttggtatgtctgttagagtgtggccagaagagattaacatttgagtcatttggctggggaaggcatatccaccctttatctgggtgggtaccatctaatcagctgccagtgtggctagaatataagcagacacaaaaacgaaaagactagactggcctagcctcccagcctacatctttctcctgtgctggctgctttctgcccttgtacattggacttcaagttcttcagtttttggactcagactggctttctttgctcctcagcttgcagatagcctattgcgggaccttgcaatcacgtgagttaatacttcataaactcccctttatatatgtctatctatcttattagttctgtccctctagagagccctaatacagattttggtaccaggagtggttctagaagaatagaatattaaggatggacttcttttgttggttttgggatttctggagttgcctgcttaatatgattagacccaaaaattctaaggactctacttctaatggcatggagaacaccgatagtccttggcatgaactatttagagagctatgcaaattaaatgcatttgacactcttgattcactgctcatgagaggcagggagtttagtgactctatacataatacctttgaccacatgtggagaaccaaagagctaatgaagctggttggttgctcctaaagttcggtggacaaagtgatgaaagaaaatgatgaactcagggattctaactctcagcttcagaagcagatactgagcctcaaatcttctaagattgccctcattgagagtcttatctcctttagagaaagagctgaaatcgtggaaaaacagacacaagctcttaccatgcgagtgactgacctgcaatgaaaggtacgtgcacagcctcgccaggtgtctactgttaaagtgagggcactgattggaaaagaataggaccctgcaacttggaatggggatgtgtgggaggaccctgatgaagctggggacactgagtttgtaaactctgatgaacatttttcaccagaagaaagagcttccccatccccagtagtggcaacattccctccctaacccatgctgccatcagcctttccacctttgtctgaggagataaatcctgcactgcctgaggcaacagtgatggcctcccatgaggcagttgccagacaagataatgttgattctcctgaggagccaaccctaacacccctgtttgtttctcaacctataactagactaaagtcccagtgggcgcctagaggtgaggttgagagtgtgacccataaggaggtgtgctacacttgaaaataagcatttgaattctctaattgatataaacagaaatctggagaacaggcatgggaatggatattaagggtgtgggataatggtggaaggaacatagagttggatcgggctggatttattgatttgggcccactaagcagggactctgcatttaatgtcacagctcaggagttcaaaaaggttctaatagtttatttgcttggttggctgaaatatggattaaaagatggcccactgtgagcaagttggaaatgcctgatctcccttggcttaatgtagaggaagggatccaaaggcttagggagattgaggtggtggagtggattagtcactttagacctactcatcccagctgggagggtccagaagatatacccttgaccaatgccttgcgaaatagatttttgagggcagcacctgcgtctttgaagggccctgtaattgctcttctctgtatgtcagatctaacagtgggaaccacagtcactcaactacaaaatttaaatatgatttaatgggatgatgggaataactggatcctgaggtggcaggggccaagtggcggcactcaaccatcaaaggcaaggtgggcacagctaccataatggacagcagaggcaaagtggcaatcagaatagtctgacttgtgtagagctctggcattggctaattaatcacagtgttcctaaaaagtgaaattgacaggaagcctactgcaatcctgcttaatttatataagcagaaaacttctagggcgaatggacaaaagactaatatgaattataaaaacagagaatcacagcccctcaatcaatttccagacttgagacagtttacagacccagaaccccttgaatgaaggggaggctgggtccccttgaggaaggactccactacactactgacaatttatgctgttaatctttctttctttctttttttttttttttgagacagagtcttgctctgtcacctaggctggagtgcagtggtgcaatctcggctcactgcaagctccgcctcccgggttcacgccattctcctgcctcaacctcccaagtagctgggattacaggcgcctgccaccacacccagctaattttttctatttttagtagagatggggtttcaccttgttagtctggatggtctcgatctcctgacctcatgatccacccacctcggcctcccaaagtgctgggattacaggcgtgagccaccgcacccggcctatgctgttaatctttctcccatccttccccaaggagacctccagccttataccagggtaactatgttggggaaagggaaatgatcagacattttggggactactggacactggctctaagatgacattgattccaggagacccaaaacgtcattgtggtcctccagttaaagtaggcgcttatggaggtcaggtaattaatggagttttagctcaggtctgactttcagtgggtccagtgggtccccgggctcatcctgtggtcatttccccagtgccagaatgcgtaattggtatagacatacttagcagcaggcagaacccccacattagctccctgacaggtagagtgagggttattatggtggggaaggccaaatggaagccattagagctgcctctacctacaaaaagagtaaatcaaaaacaatatcacatccctggagggtctgcagagattagtgccaccatcaaggacttgaaagacgcaggggtggtgattcccaccacatccccactcaactctcccatttggcctgtgcagaagacagatggatcttggggaatgacagtggattaccgtaagcttaagcaagtggtcactccagttgcagctgctgtaccagatgtggtttcattgcttgagcaaattaacacatctcctggtacctggtatgcagccattgtcttggcaaatgcctttttctccattcctgtccataaggcccaccagaagcaatttgccttcagctggcaaaggcagcaatatacctttactgtcctcctcaggggtatatcaactctccggctttgtgtcataatcttattcggagagaccttgatcgcttttcgcttctgcaagatatcacactggttcattacattgatgacattacagtgactggattcagtgagcaagaagtagcaaacacactggacttattggtgagacgtttgtgtgccagaggatgggaaataaatccgactaaaattcagggaccttctacatcaacaacatttctaggggtccagtggtttggggcctgtcgagatattcctaaggtgaaggataagttgctgcatttggaccctcttacaaccaagaaagaggcacaatgcttagtgggcctatatggattttggaggtaacacagtcctcatttgggtgtgttactctggtacatttaccgagtgacctgaaaggctgccagctttgggtggggtccagaacaggagaaggctctgcaacaggtccaggctgctgtgcaagctgctctgccacttgggccatatgacccaagagatccaatggtgcttgaggtgtcagtggcacatagggatgctgtttggagtctctgcaggcccccataggtgaatcacagcacagacctctcagattttggcaagccctgccatcttccgcagataactactctccttttgaaagacagctcttggcctgttactgggctttggtggaaactgaacatttgactatgggtcatcaagtcaccatgcaacctgaactgccgtcatgaacgggtgctttccaacccgtctagccataaagtgggtcatgcacagcagcattctgtcatcaaagagaagtggtatatatgtgactgggctcaagcagatcctgaaggcacaagtaagttttacatgaggaagtggctcaaatgcccatggtctccactcctgccaccctgcctcctctcccccagcctgcaccaatggcctcatggggagttccctgtgatcatttgccgcggtttgccatggttactacgggactgaacgaaggaggatgaatgtagaaatgaaaacaaaaaacaagaaactattttaaaggaagagcacggggaagaagagggctcccagtttctagtgagcaagggcagccaccctgagcttctatagcccttcatgttgggtagaaagatcagggagcaggaggtaatgattggtcagctccttaattgatctcaggttcacattattgctaacaggcttcatagttacctaatcacaagaaacacttgtgcgtgggtcgtgactgctctcagcagtccttctgggcagcatatgtggtttgtcagttcaccaacaacctgcttttatgagaacagtttgctgtttactcgtatagcctctggtggtatactgagttgatcgtgaccctcactctttcggcctgcaacaatcatttgacagaggaagagaagactaggacctggctcacagatgcttctgcacgatatgcaggcaccacccgaaagtggtcagctgcggcactacagcccctttttaggacatgcctgaaggacagcagtgaagggaagtcttcccagtgggcagaacttggagcggtgcacctggttgtgcactttgcatgggaggagaaatggccaggtgtgtgattatgtactgattcatgggctgtagacaatggtttggctggatggtcagggacttggaagaagcatgattggaaaattggtgacaaagacatttggggaagaggtatgtggatggacctctccgagtggtcaaaaacggaagatatttgtgtcccctgtgagtgctcaccaatgggtgaactcagcagaggaggattttaataatcaagtgggtaggatgacctgttctgtggacaccactcagcttctttccccagccacccctgtcatcgcccagtgggcccatgaacaaagtggccatggtggcagggatggagattacacatggagattcagcaacgtagccctccactagccaaggctggcctgtctacagccactgctgagtgcccaacttggcagcagcagagactaacactgagcctcaatatggcaccattcctcagggtgatcagccagctccccggtggcaggttgattatattggacctcttccatcctggaaagggcagaggtttgtcctcaccggaatagacacttactcctgatgtgggtttgcctatcttgcacgcagtgcttctgccaagactgccatccatggactcacggaatgcctcatccaccatcagggtgttccacacagcattgcctctgagcaaggcactcactttacagctaaagaagtgtggcagtgggctcatgctcatggaattcactgatcttaccacgttccccatcatcctgaagcagctggattggtagaacggtggaatggccttctgaagtcacaattacaacaccaactaggtgacaatactttgcagggctgggaccaagttctccagaaggccatgtatgctctgaatcagcatccaagatatgatattgtttctcccttagccaggatgcacgggtccaggaatcaaggcactcaagtggaagtggcaccactcgccatcacccctagtgatccactagcaaaatgtttgcttcctgttcccacgacattatgttctgctggcctagaggtcttagttccagagggaggaacgctgccaccaggagacacaactgttccattaagctagaagttaagattgccacctggacactctgggctcctcctacctttaagtcaacaggctaagtaggagttacagtgttggctggagtgattgacccagactctcgagatgaaatcagtctacagctccacaaaggaggtaagtaagagtatgcatagaattacaaaagatccattagggcgtctattaatattaccatgccctgtgattaaggtcaatgggaaactacaacagcccaatccaggcaggactacaaatcccccagacacttcaggaatgaaggtttgggtcactccaccaggaaaaaaaaaaacatgaactgctgaggtgcttgctgaaggcaaagggaaatggtgaaggtgaaggaggagcaaaggcacctcttacatggcggcaggcaaagagcatgtgcagggaactcccttcataaaaccatgagatctcatgagacttattcactctcatgagaacagcacaggaaaaccccacccccatgattaaatttcctcccacttggtccctcccacaacacatgaggattacgggagctaatattattaatacaattcaagatgagatttgggtggggacacagtcgaactgtatcaggcatcctatgggcaggccagaagtgttggttaccccttccacccatgccttactggccagaactcactcatacagccttacctgatgggggcggggtggtggtactgggaaatgtggatgcacaaacgggtgtgaccacagggtacagtgcttgccacactcagctgacgtgtttctctcccacacaccaggccacttggagatgcaagacaaagcagcccacccctggtccccatcatccccttggaatcaccttggaaaaccctggatcattttgaaagatgctcatggacgccatctcattgggggctcatcacagtatcaaggtagaagaggaagctgagaccagtaagatcacatggtggctgaaggtggtgtggctagtcagggacaggtcccttggccacagagccactggcgggtggcaatgtgccacgaccatggggtctggcagagatggcagtgtccctggccacagtgtccagcagcagcatggcagccgcagcagggctctgtggtcagacaggggtgctgctgtgacctgagactgtgggctcctttgaaggtggtgaccctgcccctcgtgtggagcccagctgtgctgtggggctgagctgtggtgtcctcctctttcaggatgtggctctgttttcactgcctaccagctctccagccttccccttggttcttggagacctgatttgcttccaatcaaccccttcctactcagtggccagcctatttctccatttgcaaccagcaaccctggctataacttctggggaaacttctggctataacttctgaggcacggagcggggcaggagcttgcccagggtcacagcgctctcggccagtctgggagtggcagccaggccacctcctcctcctgcaggaagcttcctccacctttcagcagccctggagccgcatggagcagggaagggagttgtctaccctccggcatcctgtgtgttccaggctgtgtgggagcaggtgcagctgccaggcatggcaggagcctgggcccgggccagcactcaggaatgcagcagggccctgcctctccctgtagggataaacaagtgccaggcgcccagggcagcggatgtgtctgtggctacagccccaacggcccccgcctccgcaccggctgtcctgggccagccccttgggggcctgggatgtgtggggagcatgaatggggctctgtgacccagcaactgttctgcggaaggcggctggtggctgcacaggtgactgcgggggtgggtgggggatgcaaaattctgcttcctgggcctggtgtcccccgccttgcatgaggccctgacaagacatcaccgaagcaccaaagccaacccttgtggcccaccggagacctgtctcttggatcacaggggcagtggggaggggcgcccagggctcccgatgcctctgagccctgctctgaggtcagccgatgtggctcagtcctggctgtgaggcctcacgctgccctgattccatttcctcctcagtgcgaggcagacagagcccagcctagggtctggatgggatgaaatgaagacgtctcctccctaacgggacactgtctaccccttccttcttctcccccgagaaccgtcagccccgtgaggatggggtctagggtagggcatgtggacggagctttgctgtttgtccaggtgcttatcttctagggtgccatcgcccctccccactgctgttcccgtatctgctgggtgtccccaaccccagggtggtggaggccgtctctcggatggggctgacacccaaggcacggacctgccaggtcccccaaagcacatggcctctctgcagaagaacctggatgtgacatctaatgcccaggccagagcttggggacagctggactggagccacagggtcaaggagggggagtccagaagcgcaaagtccacccagctgggagggctgctggcaggtcctttacaaagcaggcagctcctctgcccatcggagccggctggcctaaccagggcctgctcttgcctgggatgggggcagaagaggtggagacctggggccctgaggcggcactgtgggtcctggacccgcccacctgcactggggtccctgcaggcttttaatgggaacagaaatggaggaagagacagaggctgccaggggctccccgacccctactgcctgcctggggaggggtcacctcagtgtgggggaagcctggggatgtgagagcatcctaggcctgggctgcctgtggccagtctgttgtccgggtgtctagtgaaccctggggtagtgggaggggcagatgccagtctgggaagccggattgtttgaagaccaactttaaagttgggagcagtgcccagagcggggccgatgtctgctaggtggttgtctctgctttttgaaaaagaagtccccgcccgacccccgccccgccaggcgctggtctgagcgtctgagcccagatggtgcgcttgctccagagggcgggcggctccagtggcccgcgggacggtggggccagagg

SEQ ID NO: 3946 - DNA, 6728 bp, Homo sapiens
  Genbank Accession No. Z74615
agcagacgggagtttctcctcggggtcggagcaggaggcacgcggagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctggacagcctggacttcccggaccccccggaccccccggacctcccggaccccctggcctcggaggaaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcctggcagccctggtgaaaatggagctcctggtcagatgggcccccgtggcctgcctggtgagagaggtcgccctggagcccctggccctgctggtgctcgtggaaatgatggtgctactggtgctgccgggccccctggtcccaccggccccgctggtcctcctggcttccctggtgctgttggtgctaagggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccccgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggaccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgaccggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgccaaaggcgatgctggtccccctgggcctgccggacccgctggaccccctggccccattggtaatgttggtgctcctggagccaaaggtgctcgcggcagcgctggtccccctggtgctactggtttccctggtgctgctggccgagtcggtcctcctggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccccggtcccatgggcccccctggattggctggaccccctggtgaatctggacgtgagggggctcctgctgccgaaggttcccctggacgagacggttctcctggcgccaagggtgaccgtggtgagaccggccccgctggaccccctggtgctcctggtgctcctggtgcccctggccccgttggccctgctggcaagagtggtgatcgtggtgagactggtcctgctggtcccgccggtcccgtcggccccgtcggcgcccgtggccccgccggaccccaaggcccccgtggtgacaagggtgagacaggcgaacagggcgacagaggcataaagggtcaccgtggcttctctggcctccagggtccccctggccctcctggctctcctggtgaacaaggtccctctggagcctctggtcctgctggtccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggaagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctcaagggctccaacgagatcgagatccgcgccgagggcaacagccgcttcacctacagcgtcactgtcgatggctgcacgagtcacaccggagcctggggcaagacagtgattgaatacaaaaccaccaagtcctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaaaaagaataaataaataagtttttaaaaaaggaagcttggtccacttgcttgaagacccatgcgggggtaagtccctttctgcccgttgggttatgaaaccccaatgctgccctttctgctcctttctccacaccccccttggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcatcccttgtgccgcaggctgggcgggagagactgttctgttctgttccttgtgtaactgtgttgctgaaagactacctcgttcttgtcttgatgtgtcaccggggcaactgcctgggggcggggatgggggcagggtggaagcggctccccatttttataccaaaggtgctacatctatgtgatgggtggggtggggagggaatcactggtgctatagaaattgagatgcccccccaggccagcaaatgttcctttttgttcaaagtctatttttattccttgatattttttctttctttttttttttttttgtggatggggacttgtgaatttttctaaaggtgctatttaacatgggaggagagcgtgtgcgctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggccttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 3947 - DNA, 5086 bp, Homo sapiens
  Genbank Accession No. Z74616
  unsure (1)..(5086): n = a or c or g or t
agcaccacggcagcaggaggtttcggnctaagttggaggtactggnccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcatggtgctgtaggtgcccctggtcctgctggagccacaggtgaccggggcgaagctggggctgctggtcctgctggtcctgctggtcctcggggaagccctggtgaacgtggcgaggtcggtcctgctggccccaacggatttgctggtccggctggtgctgctggtcaaccgggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctacctggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacggttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccatgaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 3948 - DNA, 6372 bp, Homo sapiens
  Genbank Accession No. Z80345
ctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaattgcaaggcatactttctctgaaagtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccagagggcctgcccctcctgcttctgttcctttgccttgcagtctcctggagagagcctctcttttcctgtacagcctttgggccaaaatgcccttctagcttctccaaagaagatccgagtttatttcattctatgttttaagaggtaaaaggacataacaagtgaaagaagttttgggctaaagtaggctatgtctccttatgtattactcaatactgttttgcagagaaaacatttttcaagcatgtgcttcctgaagacacctcagtctttgggccatttgatttccaatacatagggtggaagaatgtgattttggggctgaccataaactggaaatttgtgaaatggcagtgattgggcaatcttcagtttattttttcagttgaagtggaactcatttctggaatggatttaataggctgtgtctaatgtacaaactgggtgagtcctgccttagtgtgtcctgccccaccggtacgcttccaggatactcttttcccctctgtaaagtcactttcttctgatggccagtgtcactatgatgtcagtgaggtctggggatgaggacagtgtgtcctgaaattcacaggactgacgcctcaccccagtgcacgaggattcctgtggcatcaggtgctgctgtacctggtgtaggagcctaatcattgaaccattgtgttactcacattccatgtcacagaacatatcagcctcaagaaggatttggtggaggtggatttaccactggttttacaaaggaccgtgtaaagtcattgaagttgtgaaagtctattttttttcctgtaaatctattttttacagaatataagaaacatcaatgacctgatctgtccttcctcctccttcccgcttcccccaaaatcacattccagtttttattgtctttgtgtccaaagtaaactaggtgacttatttgtataaaatgttattttgccacatgagacagtaataaaagaaagattttcacagtacgtctccctcgtcctgtctcctgattgttgggcccgttgtgttgctgaggggagcaggggcgaatgggggctccaggtttctcttactttggctattatgtggcccttctgtaagtagttgaactagagtatagctggcttctagagtgattgaggaattgtactggactttaggcttaatatttttgctttatattttcccagggtgagtggctttgtaaattgaaagtttacatgcatgttttaaaggtagggtttttttttttgagatggagtttcgctcttttttcccaggctgggatgtgatggcatgatggtggctcactgcacccttcgcctcccgggttcaagtgattgtcctgcctcagcctcccaagtagctgggattacaagtgcatgccaccacgcccggctaattctgtatttttggtagagacagggtttccccatgttggccaggctggtcttgaactcctgacctcaggtgatcaacccgccttggcctcccaaagttctgggattacaggtgtgagccactgtggctggccataaaggtaggcttattaagaaatactttaactacagtaaaatttacctcaattaagagtattgatgcattttgacaaatgaatacttttattacccatcacaatcatgatataggacatttccatcgtacccactcagaaagttcctgagttccttgtgtttgcagccaggtgacttcccccacttcgcctcttgcaaccactatctgattctgtctctattggaaaacttggatacttttaaaatgaaatttgaacgttcatatttacagtcacaaattctcaagagtctggtttagatgctctgtggcacctgaagcaattattggcctttgctcacaaacacaactcacttatttctcccttttctcctgcttcttcatcgtttcttccacccagggctggttcccaggtgggatgactgaaaggtgaggaagcccttagagcatttgccaatgggagccattcatttgactttaaagtactgagaatttagaggcgttcttttaaatgcattatttaaaaagaaaggtaacacattaaggactttgctgcatcttttgattggctttcttctaggaagtagtgaccgaggtttccactttcctccaagaggaagagacagaagttttggcaaataggtcaatgctgggaacagatgcctgcctggctgagtgctgggaaagaaaggcagttggagggatgtgtgggtgcctgggagggcgtgggtggtgcccaggaggctatgggaatcagaatcacacttgcacaagagaagacccttatgggacaagtaaaatcagcatagtttcttgggcggggcaaaggtgtcctgatgaggatgctaggggtcaaatatgtggctgggttctgccccaatcgggaatgagacacagtactgaagtggaacgggggtagcatctccacccaccttcacagcctctggggaaaagaaagctttccttgcagcccaactccaggggcctaaatattgagcgccaacacaagacaggtccttgagcttctcggagcgagtcggggaagcagataatttcagatgcaaagtgccttgaataaacagaacgaaagatagagagccagagggggagaaacggcttggtgtggtcagggcaggcatccatgagacctaaacgaagagggggcattccagacaaaaggaacagtgatcacagaggccccgagtcaggaaccagctaagggtcttagagaagagctgcctcgtaaagctaagcaacaataaccagggaatggtgggcatgggccctgatagacaaggcaggtcttggctttttaagccatagaattggattttaggagggatgggcccgccgacaaagccaacaaagttttaacccgaagatcgctatcttatttatgctttaaaaagacctctctggcctttctgcgaagctctatccttagctttctcttgttagcattttgattaacgaatgtgggcacgaacagccagctgaccgaccgcgcgcgcagtcgagcgtcggttcatcgccttgggagggaccactggaggccccgccccctggccgcgagcgcacctcggccccgctcccgaggccctacgggcgtggcctctgtcccgggtcccgccccccagcactccggaacagcgcgctcgcagcgggaggtcgcgaagcctgggactgtgtctgtcgcccatggccgccgcgctgctcgcccgggcctcgggccctgcccgcagaggtgagtgcgctggggatccgtacggcggggcttcagcccgcgtctggcccagcgggcggaggtcctggcggccggctctgtcagagccgctggcaggcggagccccactccgggagcgctcacggcctttgccccagttctgctgctccttgcgccgacccagcccggcccttcaggcgtccctggttcctgcacagacccctaccccccgattgaccccagccaccagcccagttcccagttcccatatctccctcccttcatttcacccccactagaggttcagggtgcgtccttcttccggagccaggcctgggattgaaccagacccgcatctgtgaccttgggcaagacagcccctcctcagcctcggttggcccatgtgtaaaatgtccacagagaaaatcagagttgttgggaggattaaatcatagggtatgtaaagcacttcgtgcctggcgtgtaacaggtgttccacaaatgctcgttcttgctggttaatacagtacctttcccatcttacgtgtctccagttgtagcagccgtgacacatatagccacggcttcctttgcctggcctgaattacaaggggaacgctactgagaactgtgttaagcgctagttagtctttctttcgcactccgaggagcggaatactattcgcctccacttgttatagaaacggaggctcactgacgtttaaaacccttgcctaaggtcacagagctgaggtcttattactgttggtattatactgaggactgaaggatgtagtgtatggaaatgtctagtgagtgtactaagcattcagttagtatggggttttcagtggccgccatggacattttgggctgacagttctttgttgtgggggctgtcctctgccttgttggatgttcagcagggatcccggacccctatccactgggtaccaatagtattcccctgctctagttgtgacaactagaactggctccagacattgccagatgtcccttggagggcaaaatcctccctggtgagttagtgggtcactaggattcttggagacctcctgcctcctccttccactcacttctgcccttgccggcagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgagagtgcaacctcagcagcccacgatagtggtctgccctctgctactggatgaatggtggcagtgacagtcagcggcactcggactttggtagaggaaccccaaagcagggcctggaacccagaaaatgctctggaagtttcccttgtccagcctgtggccagtagccaggacttaacttctgggacaacagtaatatgtggtggatggtcagttgcttactgtgccagccactgtgctcattctaaatagtgcctttagggtgtttggcatgcactaggcactgttcttgagatgggttatctcatctgttcctcacaacggtcctgtgaggtgaaggtactattcttatttatttttttgagacggagtttcactcttgtggctcaggctggagtgcaatggtgcgacctcgcctcactgcagcctctgcctcctgagttcaagtgattctcctgcctcagcctcccaagtagctgggattataggcgtgcactgctctgccccgctacttttgtatttttagtaaagacggcgtttcaccatgttggccaggctggtctcaaactcctgaattcaggtgatctgcccacctcggcctcccaaagtgctgggattacaggtgtgagacaccacgcccggccaaaggtagtattattatataccccatggactcagacttgtgaacaagttaaataacatacccaaggtcatggagctcatcagcggcagcctgctcgacctattttcttttttatttacttatttttttttgaaatggactctcgctctgttgcccaggctggagggcagtggcgcaatctcaacgcactgcacccctctgcctcctgggttcaagcaattctcctgcctcggcccccagtagctgggattacaggcgggcaccaccacgcccagctagtttttgtactttcagtagagatggggtttctccatgttgggcaggctggtctcaaactcctgaccttaggcgatctgcccgccttggcgtcccaaagtgctgggattacaggcgtgagccaccgtgcccggcctgcttgaactgttttctcccctgagtttcccatcagcgcgctccctcccgtgccactgtgttcttccatttgcattcagtctgtctgcagctacgcgttgaagatgttactgccgtacacgctgacctaaagatgtccagcacctggtgtaaacactcagtagtagatagttgtttaattaatgatttgtgaaaagtcaaacctctccggcctcttctccttgcctgtttttttttttaattttaattttaatttattttttattttt

SEQ ID NO: 3949 - DNA, 76798 bp, Homo sapiens
  Genbank Accession No. Z84718
aagcttgaagaattaacaccaacccttcaaaaactcttctaaaaaatagaacaggaagaaatatttttcaactcattctatgaggccagcattaccctgataccaaagacagaaaaacacattataagaaaataaagttacaaagcaatatccttataaatatagatgtaaatatcctcagcaaaatattagcaaatcaaattcagcagcatattaagaggattatacacattgaccaggtaggatttatcccaggagtacaaatgtggttcaatgtacaaaaaccaatccatatagcacttcatattaatagaaagtcacatgatcatcctaatgcagagaaggcatttgacaaaatctaacatccttttatgataaaattactcaacagatgaagactagaaaggaacttcctcagcctgacaaagagcatctatgaaaaacctataaacaccatacttcattccttgtgaaagattgagtgtttcccctcaagatcaagagcaggacaagaatgttcattcatactacttctatttattagggcaattaggcaagaaaaaggaacaaggtggaatccagatcggaaagaaagaagtaaaactatctttagtcacagatgacattataggaactcctaaggaactcacttaaaaaccattagagctcataagcaagttcagcaaggttgcaggatacaagattaatacacaaaaatcaatagtatacatttgcagtaaaggatcaaaaacaaaattaaaacaacactttcatttacaatagcatcaaaaagaataaaatacttagaataactttaaccaaagaaaagcaacacttaaacacagcaaactacaatgtgctgttgaaagaaattaaagaagcaccaccaagcaatctgacctgagaaagcatgcaggttcaacagaatgagtcctgctcttcagcaagcacccatcttgtgttcaagctgggtctgtgaggtaagtctggcaacacagagatggacacacaaccaaatctggaatgcagataaggccaagggaaggtggatcaatcattggaaacattcaacaatccatggaagaaatgttaaaaatagaatctcagggtctaatgaagtcggaatagctctcttctaggtatttctgttgaaaactgttgaataattggataaagtaaaagataagtatcggggattattaggtagcaatgaatgtgtaataaatgtaaaaagaggggcaagtgcatacaaggaagtgtatgctactgggtttctgttgaattgtgcatggaagaccatcagcagttcaagtcaaaaagcttgtcttgagggactgtgccaggctttgcagctacaaacatcatggaggaaggtgtctgcccattagaagcccagagcccagacggacggactagagcaaatcctctccctcatggagctagatgggaaaacaaaactatctgataactaacatgcaattttacatctcttaccttgtttaatcctcacaaccaccctgatgagtagtagtattatccccatttcgtagatgaagaaacaagttcttcaaggggaagggatcctcggagtagcatatgaatgagaggcagaaccagagtcaggacctatatcttgtcttctccttcctaaaactagaaaagtacccacaaccaggcagtgtttttggtgcagaggaagcagtagtgaacaaagtacgcaaaagtctctacctttagtgctcacattattgtggaggaagacaacaaacaataatcccagtagagaaattagaatgttttgctaaaaagtccttaggtggggtgtcatgatgttggtatcttatgttcaaaaaacagtaagttgaaactggggttgcatatattagtgctgttgtactagtcctttcattttctggattttaaatgttttcataatttaaaagttgggggaaaacttaaagaagaccttaataaatggaaagacatcccatgttcatgattggaaggtgtagtaatgttaagatgtcaaattcaacacagtctgcattaaaattccacttggcctgtttgcacaaactgacaaattggccctaaaattcatttggaaattaaagtgactcagaatcttcaaaataattttgaaaaagaaaaagctgtaggactcatgcttcccaatttcaaaacttagtacaaagatactataatcaagacattgccaatcaaaccacaatgagatatcacttcacacactctatgaggggtataacagaaaagacagattaaaagtattgttgaggatgtgtgaagaaattgaaacccttgtgtgctgctgctgagaatgtaaaatgtataaccgctttggaaaacagcttgcagttcctccaaaagttaaacatatatacacatatatataaaatatattattatgtatatataacatattatatatatatgggttagttttgttttgttttttttgttttttttttttttggagacagattcttgctctgtcacccacgctagagtgcagtggtgccatctcggctcactgcaacctccgtctcctggtttcaagcaattctcctgcctcagcctcctgagtaactggaattacaggctggaattacaggcaggcaccaccatgcccagctagtttttgtatttttagtagagacggggtttcgccatgttggccaggctggtctcgaactcctgacctcaggtgatccacccacctcagccttccaaagtgctgggattacaggcatgtgccaccgtgcctggccaacatagaattatattatccagcaattccattcctaggtgtatacccaagacaactgaagacatatgtccagacaaaaacttgtacatgaatgttcatcacagcatggggattcacaatagctgaaaagtagaatcaatgcaaaagtccatcaactggtgaatggataaacagaatgtggtgtatacataaaatggaatataattcagccacaggaagggatgaagtactgttatatgctacaccatgaatgaaccttgacaccattatgttaaatgaaagaagccagtcataaaagctcacatatttcattattaaatttgaatgaaatgtccagaataggcagatacttactgtccacagaggtagaaagtagatgaatggttaccaggggctaggagaagagggaaatggggagtgactgtttaatgggtacagagtttcttttaggggtgatgaaaatgatctagaattagataattgtgatggtgacaaaactttgttaatatactaaaaaccaatgaattggctttaaaccaattgaattttaaagtatattttgaaagagcggatattatggtatgtgaattatacctcataatgaaaatatgattgcattgttcaaaagagtatgaaaggaagcacacaaaaaatatgaaacataaaatatggctctttttattctaaagtgtagaaattgaacattttgtctcaggatataaaacaaaaacaaagaaagctaaaagcccttccatttggccatcttggagtaagacctaccacagtccagtgccttttactcagtcccacagcctagcctattgtttgcgtgaaactctgtagcttccactcctgtttgactgttgggtgtaaagttatgagtgaccacattgggggaagggaggaaaactccccataaaagtatatcctgggggcctgaggacagacgtgggcccagcgacagatgtgggtccaggtatcagaacgtgatatgcctacttgtccctatctcattgtccacacatagggcttggaagatggccatgttttatatcatgtgacctccaaccaatgagctgattggcttcttcaacaagagcccaggtagagattgctgtctagaagagcccatcagattctagagaatcaggcctctggcagtagggcatggtggctcatgcctgtaatcccagcactttgggaggctgaggtgggcagatcacctgagttcaggagttcgagaccagcctgaccaacatggagaaaccctgtctctactaaaactacaaaaaattagctgggcgtggtgatgcatgcctgtaatcccagctactcgggaggctgaggcaggagaatcgcttcaacctgggaggcagaggtcgcggtaagccgagatcacgccattgccctccagcctgggcaacaagagcgaaactccgtctcaaaaaaaaaaaaaagagagagagaatcagctctttgacagtggaaactcccctgggaagatgtcatagggtcctcagggtcagacacagagagaaggagacattaggacagagagaagaggcaagaaaaaaacataccttgcagtctgtgaggaacagagtggcccccaggggcctccagcccaggttttggatcaaagctcctcaaagtttaaggcgcatttggatcatctgaggatcttatgaaaatacagactctgtctgattcagtaggtctgggtttgggggtgggagcctgttagtatatttctaacaagctcccaggcaaggctgctgctgctgctgatctaatgaccacagtttgaggctggacagagtggctcacacctgtaatcccaacactttgggaggacaaggcaggagggtctcttgaggctagaactttgagaccagcctgggcaacgcagcaggacctcgtctctaaaaaacaagagagaagaagaaaaaggaaacaaaaagaagacctcaactagagtaggaagcagccaggccacatatctcttcaatggagaaaagagtttttttcttgagtaaattggagtgtacccatgttccttgtcaatgacggtaactttaaatgccaagaatgtgagagaggccgaggcggcggatcacatctttataatcctagcactttgggaggctgaggtgggaggatcacttgagcccaggaattcaagaccaccctgggaaacaaagtgtgatgccctctctacaaagtcaaaaaattagccaagcatggtggcatgtgcctgtgatccgaactacacaggagggtgaggcagaaggattgtttgagcccaggaggtcgaggctatagtaagctgagtttgcagcactgcactcactccagcctgggcaacagcaggaccctgtctcaaaaaaaaaaaaaaaaaaaaaaaaaaagaatgtgagagaccatggggaaggtgtggccctggggtaggggctaggagactacagaacaactgctagtggccccatcactgcccagaggagacagtgacctgtccaccctcatgacctctttggactccttggacaggactggctacacatgaaaatgtggggacccttatttttaaattgttaagaatgtcaagacagcaacaacaaagttttaaaccaagtgcatggcccttctgcgttgtaggcccacgaggcaggcagactggtattcacatccttgtatagccccctccccttgagtgtgactggggtctgtgctttattgcttggaagcaaggcttatccctaagccttattttcggggaggtggatttgagagctattatcctacctccttgcttggcacccttgtgaataaatctttagtcttttgcaaaactcatgtcacagtgattaatttactgtgcatgggcagaacggacctggtcctggccagtaacacccacgaggcttcctaggagactacactgccaagagagcactgagcaatggttgggagcattctgtctaaatgacttttctcttctttctaggccgggcacggtggctcacgcctgtaatcccagcactttgagaggccgaggctggcaggtcacttgaggccaggagttcaagaccagcctggccaacatggtgaaaccctgtctctactaaaaatacaattagctgagcatggtggcacatgcctgaaatcccagctacccgggtggctgaggcacgagaatcgcttgaacccaggaggcagaggttgcagtgagcagagattgcaccactgcacttcagcctgagtgacagagaggggcaaagtcaaaaaacaaacaaacgatcatcccacacactctcacttttatcttgtttctataaattaataaatacagcctttgtgagttggtttatgtgagtcagacccaaagaaaatgatcaatcctgaaacgtggaccaaattagttgttttgttttttagttggagttactctcttgtcgcccagcctggagtgcaatggcgcagtcttggcacacggcaacctctgcctctagagttcaagcgattctcctgcctcagcctcctgagtagctggaattacaggtgcatgccaccacgcccagataatttttatatttttagcagagatagggtttcaccaagttggccaggctggtctcaaactcctgaactcaggtgatccgccggcctcagcctcccaaggtgctggggttataggaatgagccaccactcccgccccaaattaggttttgaacttaaaagacaggctgagccttgaaccagaatcctgacagctcctccttgggcctctgactggagttatccagaggtgaggataaggcagccattgccttctctgagtgtctacctcctttcaaaactttaacatggaaatctgaatttctcatctttccttaattttttttccagttaaaaatcattattactggccagttgtagtggctcacatctgtaatcccagcaggtggcagaggtgggaggatcagcctaggcaacatagtgagaccctgcctctacagaaaaaaattttttttaactagctgggcgtctttgtgcgcacctgtagtcccagctacttggggaggctgagatgggaggatggcttgagcccaggagttggagtctgtagtgagctgtgatcatgccactgcattctaccctgggcaagagagtgagactctatctaaataaaataaaacagttgttacttccactttatttgcagaaatgttccttattctctagaaaacattatgcgttggctgacacactttcagtgggattcgttttagaaaatgacatgtgaccctgatactatttgacaggctccatggcagcaaggggcaggcctgggcttacggctcagcagatgaatccaggggggtggacttgcaaggactctggagggctctagcttccctgtcattttaaagatggagaaacacaggcctggagaaaggaagaaataaacccagggaatgcgatagatggcactgtgctggcaggggcaggaagaccaaggctgtgacattccagggagtgcgactgcagtgaagcgagtgaccacaaaacactgaacgtaagccctgaggctttgccacttgctggcaccaaggactctgcagtgttgagccaagaggatggactttggagccagactttctgggtctataatcattcagtgtctgtctcctcctctaaaatgcggacggtgggaaattctgacacacgcttcaacacagatgcaccttgaagacattatgctaagtgaaatgagcgagccaggcacgaaagggatgggactggggcctctctgtgcgtccccctgagagacaacggtctcttggccacccaccctgatcccacaggagccaggcgggcccagccctgagacaggccgcccgccgcccgcaattggactaaagagtgtcccaggcgtccgtgccgcccaatggggcacagcggtcggggtgcgtagccgcaggggcgtggtctgaggtccgagacccgagtcctggcactggagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtaggtccagcctcgggtttggggaaccgaaaagtcaggaaggggacaggtaggcatacatagcttagggaacttctcccagcgccaccttcttcctggggccattgctggtctggtttggagaccgaacagagaaaggtgagccagcagggagatccaagagtcagggctccccaaaactctgctcggtctcacggaatagaccacggggttcccctgaggccgaataaaggggtggggatcatgaagagaagccagacaggaggacaaaaacgggcgcagctgggtgcaggggcacacgcctgtagtcccagcaactcgagaggctggggtgggaggatcgcttgagcccaggaattccaggccgcagtgcactatcatggtgcccttgaatagccactgcactcccgtcagggcaatctagcgagaccccgtcttaaaaaaaaaaaacaaaaaaaaacaaaatgaaagcaggtgtgacctcggcctagggaaaggtgggatgagagaggtcaagggtgccaagtgtagagactgggacagcgtcaagtcccttctttatggcccagctgctgagattctgcaacagcaaacagctcaggacgtgactttccatccctgccctctgcactcgtccagtctgcattggggtccctctttgtcccttccttcctctgttcctcctgttttgcctctgaccttgtccttgtccttttttttttgagacagagtcttgcttttgctttgttgcagtgcagtggcacggatctcgaatcactgcaaccaccacctcccgggttcaagcaattctcctgcttcagcctcctgagtagctagattacaaatgtgtgccactatgtctggctaatttttttgtatttttaacagagatgggatttcacaattttggtcaggctgttctcgaactcctgacatcaaatgatctgccggcttagcctcccaaagtgctgggattacaggcatgagccactgtgcctggcccaaggcattttgtttatttgtttgtttgtttttgagacggagtctcgctctgtcgcccaggctggagtgcagtggcaggatcacagctcactgcaacctctgccgcccgaaaccttgtcctctgcctcttgttcctgctggggaggtaggttgccccaggctgctgatgctggaagcagcagggggaccctggggcttgatgagccctacaccctgttttgtttctctagcatgcctccaaggcccttgaggactcagctggcaggcccaggcccaggcccagtgcagggtggggtagtaggaggggttggaagcagaatccaggtatggctggtggggcaagtaaggcgactctacttggctaagccttctgcccagggctcccactccatggctggccctctgcctgaaacttctccacataatctcttctgcaaactgcccactgtcctgcgcaaggacttcctctgcagagtgtggagtagaggaaagggaatgggggacaggacaagaggacgtccaagctggttgtcaaatgtagtggtgcagagggaagtgtgttttcccaggagacagaggagggttttcctggtgaaggaacagtctgaagggagggtgaagagagggtagcaggctgggcatggtggctcacacctgtaatcccagcactttgggaggccgaagtaggaagattacttgaggccagtagttcaagaccagcctgggcaacatagtgagaccccaactgtaaggggaataaaagtttggggcacagggggtggtagcaggtatgctacacacagctccacagtgcccagggcagggtgaacaaagggacatggtggggccagtagaagttgcttctaagtaggtagataccagaaaaagaccacttctctgtgtttcatgaccctgccttagaattaatggtggaagggacaaggtagtcagtcccctcaggtgacctatcgtgcagcttggggtgctctgattgtgagttcatgaagctggcaatagtggaaagaggagatgggtagggtgcatgcaaaggtccaggaaccacaccctgcacagtgagctctgttgcagaggggcagcctgtgggaggaggctgtgcctacatgacttagcaaggggtgttgtctattttgtaccagccggtggagtggtctcctcctcctcccgcaggggcccttccagtctttgccaaccaggagtgcagactggtgggaagaagaactgtgaaactggggccagagcattgcagggaggggcacaggccatggcgggctcagcgttctcctcccaccacccaccatgctggactcttcccaggtcagcacttaagcgatgcctttgcccaggtgaaccccctcaagaaggtgccagccttgaaggacggggacttcaccttgacggagaggtaactgggaccctaggactgctgccaggcctgctggaaccatcctgttctaaccctctatttcatagacaaggaaactaaagtcttcagaggcagagagtctctgtgccccgcatcctgcagagagtcagtactggaccccaggcccttgccttcctgctattccagttcaccctgatgattagaaaagcaaatatctactttacttccacaccagtgctttggttgctggtgagtggtgagagtatccttgagacagggtaggccagaggacgatggcagctttgcccaccatggggcaggcctctggccaagcttgtgtggcgatggctcagtggcatctgggctgcccggtggctccatctctgggctgcagcttcccaggatgggtcttccccatggaagagccaccagatatggacgtcttacatcacagctggtcccaagaagttgaatcctcttcaggaaaagccaatctttccccagttctgccccttttgtcaccagagtcacccttcccctaacaagaacctggagtttgtgctttaaagctcatctctgaaatctcaggatggacgcacctccgatgaattcctctgacattctgccagggcccttcttcctccctggtgccccaggtgtcctgagtccttgtgtcactcagcgttgtgacccccaggtaccagccagagtcaatgtgcaatctctgcctctgtcactactctcaccttcaggtctgtggctcacagagacctgcagccctcctcagaggtggcttgaacaattggctgggagcaaaaggagctcctgggcaccctgcacagacaacggagtcgttaagctgggacacgtgtgtagccccagcttaaaagagaatataggcccgtggcagatacagaggttttctgcccttttggcctgcatgcccaacctttgggaaaccccaagttcctgaaagcttttctgtgtctccaaatggacacatcctgtgtccttccaggtccatgctcatctcatcaccatggcggccctcaaaacccagggaaggaggagagtgccagggggccttgtctgttctgttgttctaggatcctgcagctgcaggagtgcttcctgagtggtactttaggaagccaaactaccccagtcagcttagataggagctgattcttggcagaaagaatgacagaaagaacaaagggacacggaagcctttttgaacagtcaggccatcagaggctggtcggaatcccagcagatgagagtggataccgaatggaaagaactgagcttctttaaagctcagctttgatgccccgttctcctggaagctctctctggttctctgatcagaaactgtctctaaacatttggcaagacattctgttgtgggattttgcctggtggtaggaaaagcttgggtattagcctcagaaagattctcagctctgccattaagagctgtgtgccctagggcaagtctctgcctttctaagcctggttttcttctctggaaaatgaggctaatactttggcaaattgtcagaaaggttaaagaagtgtgctgggcacagtggttcatgcctataatgccagcgctttgggatgccaaggctggaggattgcttgaggataggagtttaagaccagcctggcaatacagtgagatcccatctctacaaaaaagaaaaaaggtagccaggcatggtggtgcactcctataaaaattgaagctgcagtgagctgagactgcaccactgcactccagcctgggtgactgaggaagaccttgtctccaaaaaaaaaaaaaaaaaaaaggccaggtgcggttgcttatacgtgtaatcacagcactttgggaggccgaggcaggcagatcacaaggtcaggagttcgagaccatcctggctaatatggtgaaaccccatctctactaaaactacaaaaaattagccaggcatggtggcacgcacctgtagttccagctacttgggaggctgaggcaggagaatcacttgaacccgggaggtggaggttgcagtgagccaagatcgcaccactgcactccagcctgagcgacagagcgagactccgtatcaaaaaaaaaaaaaagcgactatgtatgaaatacccagcacagtgcccttcccttacccatcatgacccccacacccacagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgaggctgggaatgtggggggcggcagcgagagcattccccaaaggtgttcaggcaccagtctcttcttttcagttttggattatttctactgacctgtctttgccttcacagattctttcctctgttgtgccaaattgctattaagcccatccaatacattctttgtttgagatatgtatttttcagctctggaaattccatttggttgttttttagaatttccacttctctgatgaaattcaccatctgttcatccattttatctgtcttttcttgtaaattctttaacatatttatcactgttacctaaaaatctttgtcaactaatttcaacacgtaggtgttctgtgggtctggtttttttgttttgttttgtttttgagatggggtctcactctgtcacccaggctgagtgcaatggtgcgatctcagctcactgcaacctccacctcccaggctcaagcgattctcctgcctcagcctcctgcgtagctgggattacaggcacccaccagcacacctggctaacttttgttatttgtagtggagaccaggtttcaccatgttggccaggctggtttcgaactctccacctgaagtgattcgtcctccttggcttcccaaagtgttgggattacaggcatgagccaccatacccagcctacgggtctatttctattgattgttgttttctccctcttgattatgggtcacatttgcctgcttctttgcatgtctcatgatgtattatcattattttttatttttttgagacggactctcactccattgcccaggctggcgtgcaatggcacgatcttggctcactgcaacctccgcctcctgggttcaagcgattctcccacctcagcctcccaagtagctagaattacaggcacctgccatcatgcctggctaatttttgtatttttgtagagacagggtttcaccatgttggccaggctggtcttgaactcctgacctcaggtgatcctcccatctcggcctcccaaagtgctgggattgtaggcatgagccaccatgcccggcctcatgatgtatccttgtgtgccagacattatgataaaagaagagcagagattgaattgcataataaacacccccaagaaagggcttgcacttccctgtgtcaggtagccaggatgtgaggctgttctcttctaagctaatcaggaggtgggctgggttgcaggtttagttggtttcagtttatctttggtttcaaatatcttgaatgtgagatcaggtcactagctcagtctagcatggctttggaatctaatcaccaactacgatgttgcctgtaagatctctctgcttttcatccctgcccccagttcccaaactgctgctcagtcagaaaagcccatgcctgtgacagtctttctcccagcctgcttgggcccaaggaaatgaaattggaatgaaagtagctcatctaggaacggcttatgcctctctggaatttagttcatttagtcaagtgctgtccgatagaagtataaagtgagccacatacgtaattttaaattttctagtaggcacatttaaaaagtaaaaagagtccaggcacagtggctcatgccaataatcctagcactttgggaggccaaggcagtggatcacctgaggtcaggagttcgagaccagcctggtcaacatggggaaaccttgtctctactaaaaccacaaaaattagccaggcttggtggcctgtgcctataatcccagctactcaggatgctgaggcaggagaattgcttgaacccagggggcaaagttggcagtgtgccgagatggtgccacttcactccagcctgggtgacagagctgaacactgtctcaaaagaaaaaaaaaaagtaaaaggaaattgatatattttacttaacccaatgtgttgagaatattatcattttggccaacaagtacaagaaaagatgcttggccgggcgcggtggctcacgcctgtaatcccagcactttgggaggcggaggcaggcagatcacaaggtcaggagattgagaccatcctggctaacacagtgaaaccctgtctctactaaaaataaaaaaaaaattagctgggcgtggtggcgggcacctgtagtcccagctactcgggaggctgaggcaggagaatggcgtgaacccaggaggcggagcttgcagtgagccgagatcaccccactgcactccagcctgggcgagagagcaagactcagtctcaaaaaaaaaaaaaaaagaaaagatgctcagcatcactaatcattagggaaatgcaaatcaaaactaactccctaccccagtaactcccgactttgcctgcccaatccccaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatgtgagtgctgtgggcaggtgaacccactaggcagggggccctggctagttgctgaagtcctgcttatgctgccacaccgggctatggcactgtgcttaagtgtgtgtgcaaacacctcctggagatctgtggtccccaaatcagatgctgcccatccctgccctcacaaccatccatccccagtctgtacccttttccccacagcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctgcttctaactctaatgtgtgatttatttgactttcctctgtcccagacctggtcatggtctctatgcaaaagacaacccccttcccaggccgtgtgggtcagcttccccctgatgtttgccaagagtgaaattaataaatgtggctgaggccgggtgtggtggctcacgcttgtaatcccagcactttgggaggccggggcagggggatcacgaggtcaggagatcgagaccatcctggctaacacggtgaaaccccgtctctactaaaaatacaaaaaattagccgggcgtggtggtgggtgcctgtagtcccagctactcgggaggctgaggcaggagaatggcatgaacccaggaggcggaccttgcaatgagccgagatcgcgccactgcactccagcctgggcaaccgagcgagactccatctcaaaaaaaaaaaaagtggctgagtgtggtagctcatacttataatcctagtactttgggaggtccaggttggggggattgcttgagtccaggatttcaaaacaaacttttttttttttttttttgagatagtgtcttgctctgttgcccaggctggagtgcaatggcatgatcacagctcactgcaacctccacctcccaggttcaagcgattctcttgcctcagtctccccagaagctgggattataggcacgcactatcacacctggctaatttttgtgtttttagtagaaacagggtttcaccgtgttgtccaggctggtgtcaaactctgtacctcaaatgatctgtgcacctccacctctgaaagtgctgggattaccatgagccactgtgcctggctccccaaaaaaatattttttcagagatggggtctcactctgttgcccagcctggagtgcagtggcacagtcatggctcactgcagccttgacatcccaggctcaagcaatattcccacctcagcctcctaagaagctgggacaacaggtgcaccccaccacgcccagctcatttcttttttatttttgtagagacagggtcttgccatgttgcccaggctagccctgcactcctgtgctcaagagatgctcccacctctacctcccaaagtgctgggattacgggtgccaagacaccgcacgcaaccaaaagaaattttttttttaattagtcaggcgtggtgatgcatacctgtagttctagctacttgggaggctgaggtgggaggattgcttgagcccaggagttcgaggctgcagtgagctctgattgagccatagcactccagcctggggcaacagaacaagatcctgtctctaaaaacacacaaagaaacccaaaacaaaacaaaacaaaacatttcctgtagccttctaattatcagagaaagtagtttatctgaccgctcagggcccagcagcatcccacatttcttggctataagcatggtgacctaacagtcggctgagttagcctcccaggacatgacccttactggtttttggattgtgtgtgtgtgtgtttttttttgtttgtttgtttgtttgtttttttgagaaggagttttgctctttttgcccaggctggagttcagtggcaaaatctcagctcaccacaacctccgcctcccgggttaaagtgattctcctgcctcagccttctgagtagctgggattacaggcatgcaccaccacgcccagctaattttgtatttgtagtagagacagggtttctccatgttggtcaggctggtctcgaactcccaaccacaggtgatctgcctgcctcggcctcccaaagtgctggaattacaggcataagccactgcgttgggacgactcttactgtttttgttttgttttcttttgcttgttttttggtatttttttgagacagtctcgctttgtcgccccggctggtgtgcagtagcgcaatttcggctcactgcaagctccgcctcccgggttcacgccattctcctgcctcagcctcccgagtagcggggactacaggcgcccaccacgtccggctagttttttgtatttttagtagagacggagtttcaccgtgttagtcaggatggtctcgatctcctgacctcataatccgcccgcctcggcctcccaaagtgctgggattacaggcgtgagccaccgcgccctgcctgactcttactgttaatcactagttttgcatttctcttgaggaactggtcaggaagagaaaacctagacagcagctctcctggtcaagacccagtcattcagaagcctaaatggcctgcctaggtgtttggctttaaactgttagcaggaatggagtactctgattgtgttttagaataatattccgggcctactacccctgcgcaccggtcctggcccagggctagctccttggtgagaaactcaaagaagtgggcactgtggctgcggttgtcctcggcggtgcccactacgccgatggaggagatggacagctgcgcgcagggctcggtggacccgctcagcgccctggccaggcccggccgtaccgtcacgttcacaagctgaggggaacatgaaaagttttacccgaagctggagccagtcgggctacgtctggggtcccgacccgagcgcgcgaaagccgaaacgcgcagtgttcgcggggacagggatcccagtacaggccgaggtccctgaaggtcacgtccgggtcatgactggggagggcgacaagggaaagacgtgcggagggggagccgcgggatcgtgaagcacggaaagtcagagcttggcctgcggaatggggtggggggtggtccctggggaaagggatcggggtcgctgttgcggaggcagagcagggacaaggccggacccctggcccaccaacttcccctcgcccagtgctgcccggcccacgctcacgtctgcaggtttgcccaagatggaggcagcgacggcgcacagccgtttctccagccccgcgggcactcggttggcggggaaattcgtgtgcagctctaggaacggcatggcgggcagaggaacggaaacagctctggcggaaaaaagctggagatacccaaggctcgcggaccggagaggaggggcgaggcgctaaaacaacctggcttctcattggctggacagagactcagcgctccccgattggctgcctagggtaccttcccacttctgcaaacaaaagtcacgtgtgccggctctgatttccggaaatccggtcgtctcggccctacgtgtagccccacccactacaagtctttaacccggtagtggccccaccctgtctcttccctgaccctcctgcttggcgtctggtggatttccctctcctcaagctttccgcggtgtggttgcctggtttctagccctattaaaggtctgaacacccctaacatacagacacacacacacctgtaggggtcttccccaagttcgaccctaataaccaatgcaaagtgagtttaaaattttttttaatgatttgccaccatttcgaagtcaggcaatttcatgttcagtatggaaatctgcgcttctcttgggcagtcaggagatgtggttacacgttgcggacgcgggtggggctgggcagggaccgttgggttcacgacatttcccgtccccgcctggttcccattgactgcctatgtagccccttgtgccggtggtgagccactgtccactagggggtggcaaaatatgttatttaaaacatggaaatccgttggtgtggcttaaacatgagtctgtggttagtgtggcaaaatcacttgaattgtacattttaaatatgattgaaattgtggtcacgcaaagtggctgacacctgtaatctcagctctttgggaggccaagaagggaggattgcttgagcccaggagttcaagaccaggctaggcaacatagcaagattcccttcgttgttttctacaaaaaaaaagaaaaaaaaaaaagaatcccagtgttgtggtgtgcacctgtagttctagctacctgggcggaggcaggaggatcgcttgagcccaggagatctagaatgcagtgagctatgactcatttttttcctgtctcttgtctgatgggtttctcttatttttctttgtttgcttttgagacagtctcgctctaagtggagcttgagtgcagtggtatgatgtcagctcactgcaacctccgcctcccaggttcaagtgattctcctgtctcagtctcctgagtgtgccaccgcacccaactaatttttgtatttttaatatagatggggtttcatcatgttgcccagggtggtctcaaactcctgacctcaagtgatctgcccaccttggcctcccaaaatgctgggattacaggggtgagccaccataccaggcctctcttaagggtttctaagagcatcttaaagaacattacctccttctgacatatcttttatcaagatccttcccggttttttgcttgttttatgtttaatccattttttcttacacaacatgtccttgtatatgtttttttgtttgtttgttttttgagacagagttttgctcttgttgccaaggctggagttcaatggcgtgatctcagctgactgcaatctctgcctcccagattcaagcaattctcctgactcagcctcccgagtagctgggattacaggcatgcgccaccatacccggctaattttgcatttttggtagagacggggtttctccatgttggtcacgctggtctcaaactcccaatctcaggtgatctgcctgcctcggcctcccaaagtgctgggattacaggtgtgctcattacagatgctaccgcagctggcatgtagtggttatttctttgttgagttctcccactgttctgagggttagaaagtcctttcataccgagacatcagacaaacgtttattgaaatgtctcctcacttcttcctagtttgacttttttcacttcatacttctccatctacgaattatgtgtgtagcaaagtgagggtttgtttattttctccccctaaaggcaagattcccaggcaacctggagtatgcaaaagagcataggattaactgctcatagctctggaattaaggcatattaggggaatccttccttggctctggtccttggtttccctcctaggaaacaagttgggtgaattaggcagtctctggcattccaggatttggtctcaggtctaaacaggattttgtaaagtgaaagcagcatcccttggcatcttgggagatgtccctgccctccatggctcgccttctgccacatggcccagcagcagctactctgcagggccatgtgctgccatgacaggtactcatccccacgggcgcgggcctgcaggtcctgggggtaccagtggtcaggtgctttgtacatgcagttcatacacagcaagctagccacactggggggacatggcaggggcagaaaacatgccctgaacactcttcagccattttctggggcattttcactatccccatgatgcagaggagggatgtgaggctcagagaggttaggtaagtgcccagggtcacacagccctacacggggccagactatcatctcaactaagggcagcaagtaagaaacaaaatgtcatgaacttcagcaggggctcagggaaggcttccaggaggaaggggcatccactgtgagtctgaagaacgagagcatgttggatatctccccaacatatccaaagcgtggacagggccaggagcaaggccagcagggagagagccttccaggtgacatggcagcattgctccccaccctgtcccatctcctgttcacctatggtgaagggttgtgcagtctgacccccagagctcatcatgcctctatgggtgttggaccatccagtgatcccaggctctgaatgtgaatccagctccaccaaggaggcactatttggcctcggtaaaggacgccaccatgcagccaccaacctagaggctggttttggctttcatttttcccacccacctccaacccttcagcaaaccctgcagttagatttcaataaaagtcagaactgaccacaatccccaccaaccctgcaccaccaccaccttggtctggggctccagcgctgcatgccagatgactgcagtggctttctcacccctgccagggggatcctttacgacgtaagtcagatcacagttcccctctgctcaaaaccctccagcgactcaatctacctgtggtaagagccaaagccttcccagtgtcccatgctcccctctgtcatgacctcctgctcttcctgctcactgcacccaccctggcccgttgctctccagtctgaaccccatgcattgtcccacctggagccttcgccctcactcttccctccagtgagaacacccttcccctcatgccttgcacattcctacagctctctgctcagatgccacctcctccagggagtcttccctcaacatcctactcataatgacacacacccccactcttaccctgtttattttttccatggcatccatcaacatccgatatgttccatgtttacatgggttactgtcagctcccccttctattaatggaatgtgagctccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctctttttttcggaggggaagactggcggtgaggaggcccggaagcagactgggccctgtggccttgtgcaagtccctcccctcctccagcctcagtttcctcacttgtacaatgcaggaggggacttctatagcccttgtcaacactgggcacctctgcctgcctccacccattcttcaccctggggctggtgcagggcccacagtccatgatccaagccatcagcagtaaacagacagctgactgactggccccacaaggcccggcagcagcccagggaccggttacctctcagccaaggtgaagtccccatccttcaaggcctggcaccttcctcagggcattcacctgggcaaaggcatcactgtgctgctggcctgcaggcgagatcagagaggtgagtggggagaaccctgagttctctgatgtctctgcccacccccactccaaactcccagcagcagctttctgaggcccctatctgggaggcatcagggaagaggaagcctctctgttagtcactgggtcacagaccctgaccctatcagagggccacctttcctgtgtccagttccttgaagcatggctcaaggacaattccctggagctgtaattcacaccccacccccagccagttccatccataggtcagacccctccagcctcctccctgggctctaggcttgccccctctgattcagcttcctatcccagctggggccttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttgtgccaaactctcaaggctccctccccactgggggttcccaggtctgactcactttagcactctaggccagtgctagaggccgcattaggtgcctggtgtttggatcagagggcatcagtcaagccaggctccagtctgatcataggcctacatgtgggcctctctggccttctactgaatggacatgcacacccctgcccattctccctccacagactgcttctgtgtccagcccctgttctgtagcaggtgactcaagctggttgtaccaagggcagcagttgggaagagtcagctgagcaggttcctccttctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagcagccccttcagctgggtgagaagccccatgggatagagcaagtcagatgcaggaaaagaaaaggcagaagaatgccaagaaatacataaaagtggaagagacccagggccagacatggtagtgcatgtctgtaatctcaacactttagaaggaggaggcaggaggatcacttgagctctggagttcaaggtcagcctggtctacatggcaaaatcccgtctccacaaataccaaaaaaaaaaaaaaaaaggaaaaaaaagaaattgctggatgtggttgcgtgcctgtggtcccaactactctacttgagaggaggaagtgggaggatcacttgagcctgagaggtcaaggctgcagtgagccgggatcatgccactgccctctacctgggctgcagagtgagaccgtgtcaaaaaaagaagaggcaagaagggaagagacccaggcagaggtaaacaaggactactccacttaggaaacaaggaggtagtttcattgttttttccaagcacatggggtgaagatattctagccccactccatttccctgccctcctgctgcatctgctctgccccctcttaacctgtattttgaagaatgctttgtattcactaagcaaagatgaagcctcttttaaaataaacaaccagcagggcatgacagctgatgcctgtaatcccagcactttgggaggccaaggaaagaggatcgcctgagctcaggagtttgagacctgcctgggcaacacaggaagacctcctctcaatagtaataataataataataataataataaattggccgggcatatcggtgggcatctgtagtcccagctacttgaggggctgagatgggaggatcgcttgagcctggaaggtcgaggctgcagtgagccatgattgtgccactgcactccagcctgagtgacagagttagctcctgtctccaaaaagtaaaaataataacatagataattacgtaatagtttccacaccagagagtctgattcttcatgttagtctgcattctcggcccgactgcaaagcagtggggacaggtggggatccgcagccaatatcccctgggcctgcctgcccagcccagctttggtcagctccactttgcgaagctcgaaggggatgccgttcttggtgaagatgtagactgaacggcagggctgggacagcaggtccaggtacagctccagacccatggcgagggcgatggggtggggcgagggagggtagacctaaacccaggggacgggccctggggacaaacccggggacaggcccgggaacaggaactgtgggcaggaacggctggttgggggcagcgggcaggaacggctgggtcaccaagcctgcagtggtgcacctcactaggagactggagcccagccacgccctccttgctcaaaggttggctccggagaactttgggccaatcaatggcgcgtctgctctcgcctttctgggatcctcggctgggggtatctttctctctaaaagggaagaggagaaaggaggtgcagcagccttcttacccagtgcctggctcagtgcccaggatggaggccagaggggaagggtggctggctgcctgcaaggctgccagccccacacctcatgaaggaatgagctgtttctccccagtcctgagggtcatatttattacactccagctaatgcctcccacagatggctaaggccctgtaagccctacccagaggtttccaacagtgcctggcattgcacagaactttctacccactattcaagtgcaactctagggcttttgatgcctgtggctgtgacactcccatttcccaagggagcctcccaaggcaggaaaatcctattcccaaatccaagattcagagaaagaccattggcaagaggatggttactggaaaacttgagaatagctttgcttctctggttccccatggttcccacctgtcgccttttttgagataagagtctcactttgttgcgcaggctggagtgcagtgggatgatcatggctcagtgtagccttgacctccagggctcaagtgatcaagtgatcatctcacctcagcctcccaagtagctgggaccacaggcatcacatctggctagtttttaaattgtcttttttttttttttttgagacagggtctcactatgttgcccaggctggtctccaactcctgggctcaagtggtcttcctgcctcagactcctgaagtgttgagattacaggcatgagccactgcacccaatcccatggtccccatttaagacctatccccccgcagaagagtgccttcctggcctagtgctgcagctctctccagactgagaggggccacattctcctgccccttcagttgcccaccccttttcacaagtcgcctttggccaggattactgcagtatccaatgtccttgcttcctccctggctgccttccagcagcagccagaatattattcttttttttttttttttttttttgagatggagtctcgctctgttgcccaggctggaatgagtggcgcaatctcggctcactgcaagctccgactcctgggtttacgccattctcctgcctcagcctcccgagtagctgggacgacaggcgcccaccaccacgcccggctaattttttctatttttagtagagacgggtttcaccatcttagccaggatggtctcaatctcctgacctcgtgatccgcccgcctccgcctcccaaagtgctgggattacaggcgtgagccaccgtgcccagcccagaatattattctaaaacacaatcagagcactccatacctgctaacagtttaaagccaagcacctaggcatgccatttaggcttctgaatgactgggtcttgaccaggagagctgctgtctaggttttctcctcctgactagttcctcaagagaaatgcaaaactagtgattaacagtaagagtcaggccgggcgtgggccggcctctctggtgttgctggaaatccttggtattccttgacttgtagacttgttttaaaatgtacctgggattttggctttattcaggtatggcgaggccacagatcagaggtgatagccatgtaaaagaaagtttgttactcacagttcccaagacaataggggggacatgccacaccatgcagggccatggggaagcaccagggtcagtcaggtggcagaatgagtgagggcaaaaggtggacaaaaggctttactgtgttttttgcaagaaggcaagacagggtaaacagacttaggactggctagttttaataattgtgatgggctctgggttataggagtggtcctttgttacctggtacctgtccctggagtgatttggggcaggaacctgctgaaaggtggctggtaaagttatgttggagatacgaatcggttgattggcccatcgaaggcacaccataagcaaatcatttattctctgtaggaattagctggcccagggaggggcagtctctcctggatcagtaaggcctcaagatgtcaaagcaatctgggcatggtggctgaggcctctaatcccagcactttgaaagtctgaggagggaggatcacttgagcccagaagttcgaggccagcctgggcagcatagtgagactgtctctacaaaaagtttaaaaattagtagggcatagtagtagttccagctactctgggggctgaggtgggaggatcacttgagcccaggaggctggggatgcagcaagccatgatcgcaccactgcactccagcctgcactcaacaaagtgagattctgtctcaaaacaacaacagcaaccacaacaaaagaagttaatagcttagcttctgctgtattccaaaattgttgcaccctggacacactgacagcctcaaaaggaggagtttgtgtgatcattggtggataaggctggtctgtgtaaatccactgggacaaatagtgcctaagctgcacctgttaaagaacaagctaaacactctccatcaaacaaaagaggtgcattccttctgctgtactgaccttgtcccagcaatgggatgtgtgtttaacaggataaggggaaatgtgctcagacctgttcctttcagcttattcattcctattcttatctatgttcttctccccatttgtagatccctcgttatgaatctggctcttatctccatagccaccaactcagcttttaatatctgaaacttctaggaaagtctgcagcaggggaaatgaaggaattaaaaacacgtcaccccaaatatgctgctttggagtattaattattttgagttgaaggcacttgagaaatagcacatgcaggaaagactctctgacctgcccttttctatctaagaataggccacacaatttcccataagaaagcaccctccctttaccaggaagagaagaacattgtcatcacaagtgactgtgaatcaaggttccaatggatctgtataaacacacgactaaaaataatccttatcttctaattttgctccgcatgtatgtcctagtcccttctccacaatttactccctataatccaagccgctttgtcttgtcattttttttttttgaggcagagtcttgctctgtcacccaggctggagtgcagtggtgcgatctccgctcactgcaagctccgcctccaggattcatgccattctcctgcctcagcctcctgagtagctgggactacaggtgcccgccaccgcacctggctaatttttttgtatttttagtagagatggggtttcaccatgttagccaggatggtctcaatctcctgaccttgtgatctgcccgccttggcctcccaaagtgctgggattataggcatgagccaccgcacccgtccttgtcttaaaaaaaaaaaaaaaaaggtattgtttttctactttagtgacttctttaggccttcattctcttgtgaaagtacccatgtacactgaaaatttagcaaaacttgaatgattttcttctgttaatctgtcttatttcagttttattcttagttccagatctccagagaccctaagaatgtagaggagaatttttttcctccccaataatagcatggcatacagcatagatccctgcttgtttaggtgaactttaatcgctttcaaaaactttctatgacattcttcataaagatcatgcaggccaggcgaggtagctcatgcctgtagtcccagctacttgggaggctgaggtgggaggatcacttgagcccaggaggtcgaggctgcagtgagccacaatcgtgccactgtacttcagcctggatgacggagcaagatcctgtctgtaagtgttttcttttttaagtaatgcatgtttcagctcagacttattccatggtgagatatatatattatatgtgtgtatgtatatatgtacatatgtatgattgcaaatgatatctgttgcattttacatattgaaggaagtatcttcttgaaaatattataaatttgtgtcaatgttgctactgctcaaaacccatttcagaattggtaatctacttacattcaaaatgagtggggtggccgggcgtggtggctcatgcctgtagtcccaacactttaggaggctgaggtgggcaggtcacttgagccaggagtctgagaccagcctggccaacatggcaaaaccccgtctctactaaaaatacaaaaattagcagggcatggtggcgcatgcctgtaatcccaactactcgggaggctgaggtacaaacttgggaggcagaggtagcagtgagccaagatcacaccactacactccagcctgagcaacagagcaagactctgtctcagaacaaactaaccaaaaaaaccaaaccaaacaaaaaaatacaacataaaggagtcacccagaaggagggtgatgcgaagacacataggggaatgccagaacagaggcaaagattgtagtgatgggtgttagattaatcatggtctttatgtcctgtactttatcatgctttgacattttttaagtttattttacatttttgtagagacagggtctcactctgccaggctggagtgcagtggcacaatctcggctcactgcaacctctgcctcctgggctccagtgatcctcccacttcagcctcccgagcagatgggactaacagacacgtgccaatgcctagctaaatttttttgaatttttggtaaagacggggtttcatcatgttgcccaggctggtctcaaactcctgggctcaagcaatctgccttccttgacctcccaaagtattgggattacaggtatgagccaccatgcccggcccagtttttacagatattttaaaaattatgtcttacagtggacctataagtgtcagaactctcatctcctttgacagcaaggataccaggattcaaagtagttaatggcatacttgaggtcaggagctaatgaatgacagagtcaggatttaaattcagggtcttggctgggcacggtggctcatgcctgtaaccccaataaggtaggagaccacccctcatattgtcttatgcccaatttctgcttccaaagaaagaggtaaaaactaaaaggcagaaatgaaatccacaggcagacagcccggcgctgcaccttgggcttggttaaagatccacccctgacctaaccagttatgttatctatagactccagacattgtatggaaaagcattgtgaaaatccctgtcctgttctgttccattctaattactggtgcatgcagcccccagtcgtgtaccccctgcttgctcaattgatcatgaccctctcacacagaccccttagaattgtaagcccttaaaagggacaagaattgctcactcagggagctcggttgttggagacgtgagtcttgctgaagttcccggccgaataaagcccttccttctttaacttggtgtctcagaggttttgtctgcagcttgtcctggtacaccaacactttgggaggccgagatgggcagataacttgaggtcagaagttcaataccagcctggccaacatggcaaaaccccaactctactaaaaatataaaaattggagagggatttcgggatcatggcagacgggaggcatagccagattgcagctccggacagagcagcatgtggaggcttgcattgtgaattttagctgcagatccactgaaagaacaaaccagcaatcctgagaggatccacagaccctctgaaggaagcagacttgctcctgtagggcccaggagacaccccaaatactgtgagtgccccagctgtggaagtgggaaagggagacccgcttctcctgagcacacacccccactggagaagctgaaggcctgtttgtggaagaagtttccgacttttcctggagctgagtcaagttacaaaactcagccgagcaaaatacagggtcagaggaagcagcagaaaggccctgggagctcactggatccccaagcagcccattcctgcctggcaccacagggatccatcaggagggtggccagaaagcaaggggtaaaactccacagctccacagggagaaggaattctctagctgaactttgtaacaatttgaatggggtgagaagcctctggaccagaacccaggggagggtgtgaatctggcttgcagatttcacaggcagaggaagaactaaagcccttttctttggcagctgggaggtggaaagcctcaggcaagttttcaattcgtctggccctccatctggaaacacactgtttgctgtttccagatggagggctgtttgcaggacatggtgggagtgagaccgccccttcagtttgcatgggagctggatgaggcctgtgacttccggctttcccccacttccctgacaacctgcatgactcagcagaggcagccataattctcctaggcacacaactccaatgacctgggcatctcacccccatcctccacagcagctacagcaacacctgcccaagaagagtctgatctcagacatgcctagccccgtcctcacctgagggtcctttcctacccaccctagtagtggtagacaaaggacgcataatcttgggagtcctagggccccacccaccactggcccctctccacactactacagttgatgctttctggagagagccacctcctggcaggaggccaaccagcacaaaaatagagcattaaaccaccaaagctcacggagtgcactgcaccgtccgccgcctccaccagaataggtgctggtatccatggctgagagacccatagacggttcacatcacaggactctgtgcagacaacccccagtaccagcctggagctgactagactcactgggcagctagacccagaagagaaacaacaatcactgcagtttggctcacaggaagccacatccacaggaaaagggggagagactacatcaagggaatagccctgggacaaaaaaaatcttaacaacaaccttcagccctataccttccctctgacagagcctaccccaatgagaaggaaccagaaaaccaactgtggtaacatgacaaaacaagggtcgtcaacacccccaaatatcacactagttcaccagcaacggatccaaaccaagaagaaatccctgatttacctgaaaaagaattcagaggccgggcgcggaggctcaagcctgtaatcctagcactttgggaggccgaggtgggcggatcacgaggtcgggagatcgagaccatcctatctaacatggtgaaaccccgtctctactacaaatacgaaaacaaaattagctgggcatggtggctggcacctgtagtcccagctactcaggaggctgaggcaggagaatggcgtgaacctgggaggtggagcttgcaatgagcagagatcgcgccactgcactccagcctgggcaacagagcgagactccatatatatatggaatatatagggaatatatatatagggtgtatatatatatatatatatatatatatatatatatatggaatatatagggaatatatatatagggaatatatatatagggaatatatatatggaatatatatggggaatatatatatggaatatatatggggaatatatatatggaatatatatggggaatatatatatggaatatatatggggaatatatatggaatatatatggggaatatatatggaatgtacatggggaatatatatatggaatgtacatagggaatatatatagggaatatatatatagggaatatatatagggaatacacacatggactatatatatggaatacacacatggaatatatatatggaatacacatggaatatacacacatggaatatacatatatggaatatacacacatggaatatatacatctggaatatatatgtggaatatatacatctggaatatatatatctgggatatacatatggagtatatatctggaatatacgtatatggaatatatatgtggaatacatacatatatggaatatatatgtggaatacatacatatacggaatacatatatatggaatacatatatattccatatatggaatataaatatggaatatatctgaatatatatggaatctatatggaatatatatggaataaatgtatggaatctatatggaatatacggaatatatgtggaatatatggaatgtatatggaatatatgtggaatatatggaatgtatatgggatatatatggaatatatggaatttatatggaatatatggaatatatatggaacatatggaatacatatggagtacatatggaatatatacatacggaatacatatatggaatatagatatacggaatatatacatggagtatatacatacagaatatatacataaggaatatatatggaatatatacatatggaatatatacatggaatatatacatatggaaaatatacatggaatacatacatggaatacatacgtatggaatacatacatggaatacgtatatggagtacatacgtatggaatacgtatatggagtacatacgtatggaatacgtatatggaatgagtatatatggaatatgtatatggaatgagcatatatggaatatgtatatggaatgagcatatatggaatatatatatggaatgaatatatatggaatatgtatatgtggaatactactcagtcatgaaaaggaattaattaacagcatttgcagtgacctggatgagtttggagattattattctaagtgaagtaactgaggaatggaaaaccaaacatcttatgttttcactgatatgtgggagctaagctatgaggacgcaaaggcataagaatggactttggggacttgaggggaagagtgggaggagggtgagggataaaagactacaaatatggtgcagtgtatactgctggggtgacaggtgcaccaaaatctcacaaattgctacaaaagaacttactcatgtaaccaaataccacccataccccaataacttatggaaaaataaaataaaataatacataaataaataaaaatacaaaaattagcaggtcatggtggtgcgcacctgtagtcccagctacttgagaggttgagctgggagaatcacttgaacctgggagacagaggttgcagtgagcagagattgcgccactgcactccagtctgggtgacagagggagactttgtctcaaaaataaataaataaataataaggctgggcatggtggctcatgcctgtaatcccagcaccttggaaggccgaggctggtggatctcctgatgtcaggagtttgagaccagcctgatcacctgaggtcaggaatttgaggccagcctgaccaacatggtgaaaccccatctctactaacaatacaaaaattagctgggcatagtggtatacgcctgtagtcccagctactcgggaggctgaggcaggagaatcgctcgaaccaccctggaggtggaggttgcagtgagctgagatcgtgccattgcactccagcctgggcgacagagcaagactccgtctaaaaaataaacaaataaattcaaggtctttccactgtgctcccccaaccttgctacacacacacacacacacacacacacacacacacacacacacacacagagttcaagcccatagaaatctggttgtctatggatacaagtcttgagtgatccccaggacagggatagagttgtgttttccaaacagcgaatcttctaattttagcatcttttgcaatctgcacaggctgataatttcccaaatcatcaaaccttggtttctttttgcttaacagctttttcctcattttatcactttcctcttgcttttcaccataaacagcaagaagaaatgaggcttcaccttcaacgctttgcttggaagtctcctcagctaaatatccaacttcgttgctttaagttcacccaccatataactatcggacacaattcaactaagctttctacctccctacgggctccttttctgggaaatgatcctccttcctccagtttccagaaacacgttcctcatttcttcagagtcctcagcagcaggatttttaatatctattttttctttttttgaggcagattctcgcttggtcgcccaggatggagtatagtggcgcaatcttggctcactgcaacctccgtctcccaggttcgagcaattctcctgcttccgcctccctagtagctgggatgccaccacgcctagctaatttttgtatttttagtagagacggggtttcactatgttggccaggctggtttgaactcctgacctcaggtgatccacccacctcagcctcccaaagtgctggcattacaggcgtgagccactgcacccagccaatatctatatatctacctacagctgcctatgatgacttaggtatgctgtaaggcaatgtagacttgctctgaccatgtttagttgatactcgtgagccctccctatagtctttaacatccatatttctaccaacaatctgtgcaaggcaatctaggttttctctatcatgggcctcataatttttccggcctctgcacatcacccaaatttaaagctacttccacatttttagatttttgtttgtttgtttgtttgagacagggtctgactctgttgcccaggctggagtgcagtgtcacagtcacaggtcactgcagcctagacttcccagcctcaagcaatcctcccacctcggtctccccagtagctgggactacaagcatgcactaccatccccaactaattttttttttttttgagacggagtcgcgctttgttccccaggctggagtgcagtggcgcgatcttggctctctgcaagctccgcctcctgggttcatgccattctgctacctcagcctcctgagtagctgggacaacaggcacccgccaccacgcctggttaattttttgtatttttagtagagactgggtttcaccatgttcgccaggatggtctcaaccttctgacctcgtgatccgcctgcctttgccacccaaagtgctgggattataggcgtgagccactgctcccggcccatccccagctaatttatatatttttagtagagacggggttttgccatgttgcccaggctagtctcaaactccagggctcaagtaatccacccaccttggcatccgaaaatgttgaaattacagacatgagccactgtgcccagcctagattttcttttttatagcagcaccctgcttcctggcaccaaaatctgtgttcctctcctctggatggtataacaaattaccaccaccttggtggcttaaaacaacataaatctattctcttacagttatggagaccagaactttataatctatttctctgggccaaaacccaggtgccaatagggttgcacaccctccagaggctctgagaggggaattggtttcctcaatttttccagcttttggagctgcctgtcttgggtcatgtagccccttcttccatcttcaaagcccacaatgtagcatcttcaaatctctctgcttccatcttctcctgtcttctgtttcaaatctccgtctgtctcctcttacacagatacttgtgactgcatttagggctcactcagataatccaagacaatgcctccatctcaacattcttaatcaattctgcaaagtcccttttgccacagaaggtaatattcacaggttccagagatcaggacttgtatatccttaggggtcattattcagcatatcacaggaaggaaagagaaggtgtccctgtgctgtggtttgaatgggtcccccacaaagcatgtgttggaaatgtaatccccaatgcaacagtgttgggaggtggggcctaatgagaggtgtttatctcatgaggcctccaccgttacagatggattgatgtggattataaaaggactttgaggctgtgagttcagcctcttgctctctcttaccctctctttatcctttcaccaggggatgatacagcaagaaagctctggccagatgctggcccctcgatcttggactttccagccttcaggaccatgagccaacaaatgtccaccccttataaattaccaccaggcttggtggctcacgcctgtaatcccagcactttgggaggccaatgcaggcagatcacctgaggtcaggagttcgagaccaacctgtccaatatggtaaaaccctgtctctactgaaaatacaaaaattggccctgcatggtggctcacgcctgtaatcccagcactttgggaggctgaggcgggctagtcacgaggtcaggagatcgcgaccatcctggctaacacggtgaaaccccatctctactaaaaacacaaaaaattagctgggtgcagtggtgggcgcctgtaatcccagctactcgggagactgaggcaggagaatcgcttgaaactgggaggggtccctgtgccagggaccttacatgtttccaggtgtcaccccaacccagaaaggactgcgccccgccgtcctggaaaggccccagcgcatggacatctgagggttcgttcagagctctgtttctcggagctggaaggtggcagaagggagggagcgaatgggatcctctaaaagggatctcagactttcacccagcgggatatgacacttgcaggtgtcccagacttgtgggaaccttgactggaaggctggggttaaggatgaactttctgccgtccagactgtcccctgcagagcagctgctgccagacagcgggagctcccacctcgtgcacaggatgggggcagggagcccgcagccgcaggaggcaggaatgactgtgcagggagcccgcagccgcaggaggcaggaatgactgtccgggaacctcctttcttctccctgaatcccagccctggcatctaaccagggtgcacagtgatggtccagggctgggcccgggactctagctgaatctttcagagtatcccatccctctggccagtggcccaagcgagtgaaccagaatgcttccttgggagttttgaaattggaactggagagaggagctccctatggggaggtaaatgggagctggggccacctgtagtgacatttcctgagttcatggagtaggctagtctgagagagaaaagctgactcagagaaagggagtgataacagggcgtggtagcccacacctgcaatcccagctaatcagctcgggaggctgagacccaaggatcactttaggccagaagtttgtgatcagcttggacaacatagtgagaccctatctgtctctctctcttttttttttttttgagacagagtctggctctgttgcctaggctggagcgcagtggcgtgatcttggctcactgcaacctctgcctcctgggctcaagtgatcctgccacctcagtctcttgagtagctgggactacaggcatgcgccaccatgcccagctaatttttgtattttttgtagagactgggtttcggcacgttgcccaggctcgtcttgatgtcctgggctcatgtgatcagcccatcttggcctcccaaagggctgggattgtaggcacgagccgccctgccaggcccaagggtttttttgtttttgtttttgttttttttaactagtggggtatggtcatgtgcacctgtagtcctaggtactccagaggctgtagtggaatgactgctggagcacaggacttggagattgcagtaagccatgatcgtgccactgaactccaggctgggtgacagagcaagattctatgtcaagaaagagacagagaattaaaagaaaaaagtgtagggagacagagatcctgtctcaaagaaagaagggaggaaaggaggaagggaaggaaggaaagggaagggaggggaggggagaggaggggaggggacaggaggggaaggaggggagaggaggagaggggaggaaaagtggggagacagaaacaggttctgattccagttctcttagtggcttctacacccctcccctcctatgactggagaagttttctgagaaatctccccacccaccccactccctttgttttttttttgttgttttttgtttgtttgtttgtttttgctaagccaattgtcattgagtttctatctgaaacccccaaagggacactggccacccctgcctccactctacagaggtggagaaaaggggagaggggcttggcaggcctcccagccagtcatggagggaataggcttcaggaggagtacagagttctggccccattttgggggaaggcactggccgagaagggctgagcaactcctggaggtacagacctctggggagggcaggtgggaggagcagcaatggggcccaagctgttcctggacatgcactcagccccctgccatgctatccacttttgccaggcagaatgacatcccttttcagctgcagacagtggagttggcttggggtgagccaggtggctgggctgggccccatggagtgggtgccaaggaccaggccctgcactgagccttctctcctttctgcccaccaggggagcacctgaagcctgagttcctgaaggtgaaccccctggggaaggtgcctgccctcagagatggcgacttcctactagcagagaggtaatggtgacctggtgcccacccagggtcagagccaggatctgcctgggttctggggctcagagttgtagggggaggcagaggcgagaggggagatctttccttgggttggagatctttccaaatcactgtggccccttcctcatttcagcctgtgtagctccgatgcagaggctggacccaggggcacctttgggctaaagctggaggctggaacctggctagagtctaagccagctggagctgcccagatggggaaaggacgtaggtcacccagataaacctggacaacctgaagccagcgggcaaggcccaggcttgaggctggctcctccccaaatgtccccagctcatcctttcagagtcctaggagctgggcagacccaggggagactccacattcaatcccagctcaccacttcctcaatccatgcccttggggaaatcacagaactttgtgtgccaggtttctcctctgtaaaacggagtgggaggaataatgtatccacctcccagggcttacctgaggatagaaaatgggcacctagtgttctggggcactaggaagggaacttggagaccttttgggcagggcccacacggcaggcactctgagtggggaccctgatgccagggagtggggcctgggcacagagggcaggatggtatggtaactgggaggggaggtggaaacatgggcccagggaggatcagagttggaaatggagaaacagagtggtttggtcgtggggagatactgcctggagggagttgcagtataggggaggtcctcccctgaaggtgaaggtggggagaaaacctggtcaaatcaccctgagtatgagcaatgaagccacctggccctgacaggctggagaaaagatctctgacaccccctgcccacagcatggtcatcgttttatacctgagtcgaaagtaccagatacggggacactggtacccacctgagctgcaagcccgcacctgcgtggatgagtacttggcgtggaagcatgtcaccatccagctgcctgccaccaatgtctacctgtgcaaggtgagcttcctaggccctgtcatgcaggctggggcaggggcctggacccccagagatggaaggtaccagttggtacatattacatattagcttcacttccactgtcctcagcagacataactaatctatcacagtactccttcccctaagcctgaatgaatccttagaaaccttctgaacacagagccccagaggacatcactaatgaatggcagccgggaagggatggagaggaggcccaagaggcttccaagagtctgggttaagttgctcctctcctcacagcccagtctctcctgccccacttctccagacagcctgcagatgctgcacagctggagcggctgttggggaggctgacgccagccctgcagcacctggatgggggggtcctggtggccaggcccttcctggcaatggagcagatctccctggaagacttggtgctgacggaggtgatgcaggtgaagctttcctacccacctgccctcggggggactctgggcatggggctgagccccaaccccagctgccctgtcttcccagcccactgccgttggctgcgacctcttccaagactggccctggctggcagtgtgacaggcccatatgaaggctgcccttggtactgagctcttcctggaggcccacaagctcatactccagcctctgaaccacagtgaggctcggcaggacccccagctggcccagaagcaggtgcagttgctgcaggagtggctccactgagtgggtacagcccactgcactgcaccctgctgtctgcaataaacacactgcatgctcttcgcttgtctccaggcttactctgtcactggaagtgggatcagtcccatttctgagcctagacctattaaatcacaaagcatagagtgagtggcactcagtcctctacgtggggctctagttaccttcctgggccaccaggtgcacagtctggccactgcagccccaacccaggccaggaagtttctgggctcctctgcatggcatacactggaggattaattagtataggaagggtataaccaacattttcagggtatgggcccaatagcttacttagctgtccttactgtggggtgtgataggatgtggtgtattatgtagcacggagaattttggattctcatgggtaggttcaattcctgtaattctagaaacaaaagggtttaaacctctgtaatttattctatcaaagtaactcttttgtgagacatatttcttatgtttggggtgggatgctggaggttaggactggcatgaagatatgtcatatgaaagtactagtgtgagtggtagaaaattttttcaaggagatatatgagctgatcataatggaatcaggaatatgatgttcgaattcataaaaaaagacttgttaaaatgagagtttgggtgacgaaatttgtggtatagagttctggtatatatatgttatgcagtgctcctaggaagacaatagtgattacgggatttattatttatttattttttgccctagggcgaaggtggcttttatttcctctcttagggaagagggggaggtgagctttcccaggcacgtcaacctaaggaaggggtcgtggggcccccagcaggggctggaagagctgatcatttggaagaaagggttcattcttgtccacttcctggccctcagctgcagggtgtgctggcaggggttactccccttggggcagctgctcctgcatcagcggaggcacaaggaggtacctgctggtgttcacaaagaggagggggcaggtgccgcgagtgagggagagagggctggggtgactggccccacaccaatgcctgcctagtatgatcactttcataaggcctggctggtgggactcctccaggaagggcctgaggggtcccttggcagtgctccatgcgatggctggtgctttaaatgtccatctcaaaactgtgcttcttcactgcccgccctgcttatcttctggactattgctcaggtggctctggctggcttccgttggggggatcatcactggcagggctggtgaccccgggaatggtgggcagatcccttgggagtgttttggtcacgggtaagtttcaacactccatcaggaatttccagtggtagatgatcctggtacctcctggggtggtgctgaagagcatgccgccgggggtcgcgctgtattccccgggcgggtgggagctgcttgccttcgccaagcaccacctggcaagtggcagggatggcccagcttggggtctgctgcagctgctgtccccagatatggtctcctgtgcactgcacccacgaacctcttgcggccttcagggcatttattataatgatatttatatagtctgctataaagaacagggcaaatgggcctgcagcatattcgacgttaaagcccgagattaattctgattccccctctgttaggtctaaagaggctcggctggtttctgctagtgtggaaataagtcatattatggccagaggtcatgatggtaggagcagccagagaaattcttctgttccaatgagtatatacaaattaaatgaaccacttattaataggactgataggaggataatagctagagtgacttcatatgagactgtttgggccactgtacatagtgcaccgatgagtgcatatttcaaattagatgctcatcctgatcacaggatagagtagacagctaggcttgatgtggctaatataaacaggaggcctagttaagattaactagagaatggggtatggggagagggattcatatgaggagggcaatagatagagctagagttggaacaataatgtatagggggtgtatttttattacattattgtacattatacaacaatatgttaaaagttttattgcatctgccactttcattgccgagtgccccctgacttcctggtggtggtgtccccactgctcccgaagctcccaggttcctgtgtctctttctcccaattcctttctagtcatagttcaggctccattcacctgtggatgctcccagcctctacttctagaatcctccagggataattctcattgcctcctcctcattctggaccctgcaaagcccctttcgtcaggttctgcaatcaaagtccggccctgggaattcccaggcataatcccttctcagacagggtgtctgtgaggtggcgccacgggacacagacacacgtgagagggggagagtagggtcacggctgccacacctttgccacgggcctctgccagcctactcctgggcctccttagaatccttgatgctgtgagaattgcaggcttcctggccttatgacaacacaaagggaaacaagaggttccagaatgcagggtcctgggcccagatcggagagggcacagggccagggactctggccagacataggcccaggtctgtggctggctagctgcagctgtggggcctggcatgtgtctcaacatggccctggagctctacatggacctgctgtcagcaccctgccgtgccgtctacatcttctcgaagaagcatgacatccagttcaactttcagtttgtggatctgctgaaaggtcagctcccactgctgcctggcaggcctggtcctggggggaggcaggacacacagattggagctttttttttctttttctttttggtagagcctcactttgtcacccaggctggagtgcagtggtgctatcttggctcactgcaatctccactgggttcaagtgattctcccagctcagcctcccgagttgctgggtttataggcaaacgccaccatgcccggctcattttttgtatttttagtcgagatggagtttcaccatgttggccaggctggtctcgaacccctgaccaaaagtgatctgccccgcctcagcctccaaagtgctgggattacaggcgtgagccaccacgctcagattgataggggcatttctgagaagcagggacagagacaagggaatcaccccagaggtccacagggaaggaaaagatgccacggggcttgtaggctgcgtccctgcctagcctaccttagccactccccactaatgatagtccccacgccacagatgaacaggctttttgaggagaagggggaatgaacagcagctgggactccctgggctcccaccaggcaccctggcttcgttgtgggattctaggaccttgtgaactcagcacctgcccaccaggttggcaaagggggcagaagtgcacagtccgtctacacccatcctccccagtgttcagaaaggctcagggctccactgctcccgagtgagggtcagaggggtgggctcccactccatcccgagcacagagggactccaaaactcagcctgcaaaagcagaagcctctagaacacagaggaagagacaggaaagctgtggaaatgaacgggctgcgagtggagcccccagaaatgtttccaactggaggcggctggtccaggaagagtttcagttcctgcccccacctcaggttccctgttaagatgaccctgattgtgtccgagaagcttccctttggatgtccagctgtgtgctgggcctggcttccttaaagtggagacagagtgagagcgatgggattgcggatgggacccaggccctcagggcttcaggtgattcaaaggctgtgttttcagatccagctttgggggtgggcactggaggcctccggcttctgggtaaaagggtcgtcctggtcctgggacacaggtaggaggcacgggagtcaccaaacctagggtggagcaggctgggagccagcagttctgatcccagtccggttctgcaactgccttgccctgtgacctggggtgagccgccatgtccctccgggcctcagtcctctcttcttgagaaaatagagagggaggcgtttgtgtctctgggagtctcagttctctctcccctggagtcccacagcctcagaccttccctgctcctcccaggtcaccaccacagcaaagaatacattgacatcaaccccctcaggaagctgcccagcctcaaagatgggaaatttatcttaagtgaaaggtaagtcttccctggggcccttgcaccatctgtctctgctcctcctgggaggttcagtgcgagcatttgtctgtttgaccatggaaaatctcacacgtgcactaaaggagagtgaatactaactaatgagggacacgaggaaccccacaaatccatcgcccagctctgactcttgccaacttggggtccagtttacatcatttctattcccctgcctcccagacaccccatcattccattcataaatgtttaggggccagctcatgcctgtaattctagcactttgagaggctgaagtgaggggatggcctgagctcacgtgttcaagaccagcctagcctagacaacatggcaaaacccccatctctacaaaaaatacaaaagttagccagcatggtggtccgcacctgtagtcccagctactcaggaggctgaggtggagggattgctggagcccgggaggcagaggttgcagtgagcaaagattgagcttcagcctgggcaacagagtgagaccccatctcaaaaataaaaataagtaagtaaataaatcaataaacgttcaggaacatacctcttagagataagcgttctttaaaaaaaaaaaaaaaaaaaaaaaaagcaacaggctgggcgcggtggctcatgcctgtaatcccagcactttgagaggctgacacgggaggatcgcttgaggccaggagttcacgactgcagtgaactccgattgtgccactgcactccagcctgggctaggatagagcgtagcatcactacgataccattaagatacctcataaaattaacagtaattcctggatttcatctaatacgtggctcctgttcaaaactctctgattatctcctaaatattttcttggcagtttgtttggatcaggatccaaagaagttctgagtcttgcagccagttgctgtctctcctgccactttttaaccgatagctctctccatgccctgacctttttaccttggcatggttgctgttggtgatgataaaggagcccttgtgctgcggaggttcccacaccagccatcaatcagcaaggcctaggacatcccctccgaagcatgtctcccctccgtccccttccctctgtccccatggcctccaccatccccagacaccacaaccttcccgatagttgctggcctccccactatccattctgccccctcgggctcaccctccatccagcaccagagagatggatcctttcatgccctggcttatataatgcctaatcttaagcattaagtccataacctccctgcacctccaggggctaccctccgtggactccacagtgtctctggctgcctcatcactccccaatcacccccacccttcttccagttgcaaccccctactctcttttcttcagatttaccttgctccctttaccctcgtatttcagcatgtgtttttctttgttggttttttgagacagagtcttgctctgtggcccaggctggagtacagtggcacaatcttggctcactacaacctctgcctcccaggttcaagtgactcccgtgcctcagcttcccaagtagctgggattacaggtgtgtgccaccacaagtagctaatttttgtattttcattttagtagagacagggtttcaccatgttggccaggctggtctccaactcctggcctcaagggatctgcccccattggcctcccaaagtgccgggattacaggtgtgagccatcgtgcccccccgtttttgtttttgaaaaaggatcttgatctttcacccaagctggagtgcagtggtgtgatcttggctcacagtagccccaaattcctgggatcaagtgatcctcccacctcagcatcccaattcaacacgtgttgttccccctgctggcctactctttgttataccaccagcccccaactcctactcaccccgcagggctccttcccagcccttactgactgtcagacagacagctctggtgaaggtctttctcggggccgtttgggctcctctttgctctggaagccccagcagttgggcccaggccacaccggggtggttgacgtagtggcactcaggaaggcaagggcagtgcccctgaccggccccttctgcagcgcggccatcctttactacctgtgccgcaagtacagcgcaccatcgcactggtgcccgccagacccgcacgcacgtgcccgtgtggatgagttcgtggcttggcaacacacggcctttcagctgcccatgaagaagatagtctggctcaaggtgagcagggccacttctggggcttggggacacgggcacagggaagtcaggaaggctggaggccagttctggccctgctgactgccggcgacctcaagcaagtctccctccctctctgggcctcatttcctcagctccttctcctgcccgccttacagagccgtcaggagtgtggactgaaacaatgggcatgaaagagtcttattagggcgaggggaagggcatacgggaggggctgatgtgactcacccaggacagcattcgaggcatttcattctgaactagagaatctcagcgtcaaaaggcccacagaaggccgggtacggtggctcacaactgtaatcccagtactttgggaggccgaggcgggcggatcacttgaggtcaggagttcaagacctaccttgccaacattgtgaaacaccatctctactaaaaatacaaaattattagctgggtgtggtgatgggcacctgtaatcccagctactcaggacgctgaggcaggacaattgcttgaacccaggagttggagttggcagtgagccaagattgtgccactgcactccagcctgggcaacagagtgagactccatctcaaaaaacaaaaacaaaaaagagtatggcctatagaaaattagaagatgacaaataaccagtacatgtgtctctactttgaattctatgcctgtgacagacatcactaatcaatcacaggacttatgcctgctgagctccccaaatccttgtgaacacatggttcccagcaacttccaccaatcagaactgctaaaagaggtgaaactgctttatatcctgggaagtgttcaatatctatccagcagacaagagtacagagacctggcagggcaggtggccctggagtgcagcctcctcttccctcctcttcccaaccctggccagttgctgatcccaaagataacaggggaggaagtttcagctgagaagatggagcatgcagtggaagaggtgaagaacagcctgcagctctttgaggagtattttctgcaggataagatgttcatcaccgggaaccaaatctcactggctgacctggtggccgtggtggagatgatgcaggtgtggagtggattggaggagggttagaccctgggcagaggtaggactcctctgtgaccaatggggccatcacttgaggataggctggtgaggcgggaaaggcaggcagagctgccatgggggctgcgggaaccaggcctgggggcctggactcaatcggggcaacaggaagcacagaatgttatgaatcaggaaggatcacagttctccacacttgacaaagattcttcggtgtgggaggacccggagggtgagcctgggatagagaagaacactgcatttcctgctcaatccaccagcatcccagatacctcctcctcttgctggactctccaggaaatgttcactggcttcctgggtgtccttctggccctgcctgtttcccagagctccagacagacagctctggaggacagctctcgtggctgggtctgaggggcatccactgtgcatttggaggcacacctgagtgtggggcatttatgtggcctctacatgcaggggagggtgaccagttctgcttgtcaagacactggccagggtctcaactggccatcctgcacaccagctagggcactgcacactgaccaaagagactaatttgcatatcagccagagatatgcccgagaggagggacctggggtcctggtggattgaccagaaaatgcagtattcttttccttatcccagagatctctggctgatatgaaaattagtctccttggtctgtttgcagggcagaccagcaccaggaaaaatcattctggcctgccccaagggttcagccatatgcttcgtccccaccccttacatttcacccacacacacccattcttgggcttcccaaagatcttgggtgcaaaccaaactcttagtaagccagcgaaactgcagggtagactgcccgccaggtctcccatcctagcccctgagcttgatcacagtgggaggctaaacatggaggaaaaaacctgagttctctccctcatccacatatacacacctgggataaggggtctccctggaagaaggcaggattcatgcgaggtcgcaggctggagaagtgggaagtgcctgggccaggagccctctcagcatggttcagaaggcttggagcaagaagaccagtgactgaggactctgagggattctggatcctccatccccacctacatctattacatagtctgtgaccccttgctcaggccttgggggtcagcagcctaattctttgcataggtagatgttagggacgtgggcctgaggctgtgggagaggacccaggtggggctggtccccaggctgaccacgtctttgtcttcgtctatccacagcccatggcagccaactataatgtcttcctcaacagctccaagctagctgagtggcgtatgcaggtggagctgaatattggctctggcctctttagggaggcccatgatcgactaatgcagttggccgactgggacttttcaacattggattcaatggtcaaggagaatatttctgagttgctgaagaagagcaggtgaccctaggcgcagcctgtcccgcagggcctggctggcttagcaatctgagccaccttccttaaaggaaatgttaaaaaaaaaaaacaaaaaaacaaaaaaacaactgttctttgcctaataaagaactggaacaaccatcacagctgctgagcagcagacagttggcatatgcatagggtctgatgtgggagtgggtggtggttacagatccttccagtttccaaaaagaattttaaaagtaaagggttaaatatggttacattgtgagtaataatagttggtgacttcaataccccactttcagtaatagaaaaactacagaagaccatcaaggaaatagggaatttgaaaagcacgattaaccaatcgcatacactagacatgaacagaacgttccacccgacaggagcagaataagcattcttctaaagagcacatggaatattctccagtatagagcatatatttggtcctaagtctcaaatttaagatgattgaaatcacacaaagtatgttctctggacacagtggaataaagttaaaaatcaagaacagaaggaaaactagaaaactcacaagcacatagaaattaaacagcacactcttaaacaacaaatgggttaaagaagaaatcacaagggacatcaaaaagtatcctgaacaaataaaaatgaaaacacaacatgcccagatttataggatgcagcagaagcagttctaagagcaaaatttatagctgtaaacacataagttaaagaagaatgatcttgaatcaataacctaactttacaccttaaggaactagaaaaataagagcaaactcaacccaacaccactagaaaacaggaaataataaagattagaatggagataaatgaaatagaaaatagaaaagcaataaaatcaataaaaccaaaaattggatctttgcaaagatcaacaaaattggcaaacctttacttagaatagccaagtgaaaaaaataagggtcaaattattcaccaagaaagaaagtggaggctgggtgcaatggctcacacctgcaatcccagcactttggaaagcagaggcagaaggatcacttgaggccaggagattgagaacagcctgggtaacacaatgagacttttttctaaaaaatatattttttaaaaaaattagcttggtgtggtggtgcaagcctgtagtcttagctaactgggtggccgaggtgggaggatcactcgagtccaagagttcaaggttacaccgagctatgattgcaccactgcactccagcctgggcacatagaagaaccttatctcaaaaaacaaacaaaaacaaaaatgaaaaaatgaaatggaaaccagaaagaaagaaaatggagacatcacattggtcatagagaaattcaaaagtttagaaatactatgaataactatatgtggacaatttagacaacctagatgaaatgggaaaattttagaaacacacaatctaccaaaactgacttaagaagaaagataaaattttaataggcctgtaacaaataaagagattaaaatattaattatttttaaaaattccacaaagaaaagcccaggaccagatggcttccctggtgaattcaaccaaaagcttgaagaactaacacaaagccttcacaaactcttccaaaaaaataaaacaggaagaaatatttttcaactcatactatgaggccagaattactctgataccaaagacagaaaaagacattacaagaaaataaagttacaaagcaatatccttataaatatagatgtaaaaatcctcagcgaaatattagcaaatcaaatccagcagcatattaaaaggatcatacaccttgaccaggtaggatttatcccaggagtacaaatgcagttcaacatacaaaaatcaatcagtgtagcataccatgttaatagaaagtcacatgatcatcctaatgcacagaaggcatttgacaaaacctaacatccttttacgataaaattactcagcagatgaagacgagaaaggaacttcctcaacttgacaaaaagcatctatgaaaaacctataactaacaccatacttcatccattgtgaaagatcaagcgtttcccccctaagatcaggaacaggacaagaatgttcattcacactacttctacttattagggcaattaggcaagaaaaaggaacaaggtggaatctagatcagaaagaaagaagtaaaaccatctctattcacagatgacattacagaaattcttaactcacttaaaaaccattagagctaataaacaagttcaaggctgggcacggtggctcacacctgtaatcccagcactttgggaggccaaggcgggcagatcatgaggtcagaagtttgagaccagcctgtccaatatggtgaaaccccgtctctactaaaaatacaaaaattagccgggcgtggtggcgcatgcctgtagtcccagctactcaggaggcaaaggcaggagaatcaccagagcccaggaggtggaggttgcagtgtgccaagatcaagccactgcactccagcctgggtgactgactgagactccatctcaataaaataaaataagttcagcaaggttgcagggtacaagattaatacacaaaaatcaatagtatacatttgcaataaaggatgaaaaacaaaattaaaaccacacttccatttataataccatcaaaaagaataaaatagaataaatttaaccaaagaaaagcaacatttcaacacagcaaactacaatgtgctgttgaaagaaattaaagaagcgccaccaagcaatctgacctgagaaaacatgcaggttcaacagaatgagtcctgctcttcagcaagcacccatcttgtgttcaagctgggtctatgaggcaagtttggcaacatagacatggacatgccaccaaatctgtaatgtagaaaaggccaagggaaggtggatcaatcattggaaacattcaacaatccatggaagaaatgttaaaaatagaatctcagggtctgatgaagttggaatatcactcttctatgtatttcggttggaatctgttgaacgattggataaagtaaaagtatagggaattattaggtagcattaaatgtgtaataaatgtaaagagagggtgcaagtgcatacaaggaagtgtacgctactgggtttctgttgaattgttcatggaagaccatcagcagttcaattccaaaagcttgtcttaaaattagctgggtgtggtggcgtatgcctgtaatcccagctactcaggaggctgaggcaggagaatcgcttgaatccgggaagcagagattgcagtgagccaagatcgcaccactgtactccagcctggtgacagagcgatactctgactcaaaaaaaaaacaaacaaacaaaaaaaaaacttgtcttgagggactacgccagccttaacagctacaaacatcatggaggaagctgtctgcccattagaagcccagagcccagagggacagactagagcaaatcctctccctcattggagctagatgggaacacaaatctatctgataactaacatgcaattttacatctcttaccttgtttaatcctcacaaccaccctgatgagtagtagtattatgcccattttgtagatgaagaaacaagttcttcaaggggaagggtagcatatgaatgagaggcagaaccagagtcaggacctatatcttgtcttctccttcctaaaactagaaaagtacccacaaccaggcaatgcgtttggtgcagaaaaagcagtagtgaacaaaataggcaaaaatgtctgcctttagtgctcacattgttgtggagaaagacaaacaataagcacagtagagaagtaaaaattagaatgttttgctaaaaagtccataaaattgaatattattcagccataagaagggatgaagtaccgttatatgctacaacatggatgaaccttgacaccattatgctaaatgaaagaagccagtcataaaaggccacatatttcattattccatttgaatgaaatctccagaataggcagctacttcctatccacagaggtagaaagtagatgaatggtaaccaggggctaggggaagaggggaatggggagtgactctttattgggtacagagtttctttttgggtgatgaaaatgatctagaattagataactgtgatgttgacaaaactttgttaatatactaaaaaccactgaattggctttaaaccaattgaattttaaagtatactttgaaagggtggatattatggtatgggaattatatctgataatgaaaatatgattacattgttcaaaagcatagggaagaagctacaaaaaatatgaagcataaattgtggctcttttttattctgaagtgtagatttgaacattatatctcaaaatataaaacaaaaacaaagaaagctaaaagcccttccatttggccatcttggagtaagacctaccacagtccagtgccttttactcagccccacagcctagcctattgtttacatgaaaccctgtagcttccacccctgtttgactgttgggtgtaaagttatgagtgaccatattgggggaagggaggaaaactccccataaacgtgtatcctgggggcctgaggagagacgatggaccaggtagcagaacatgatatgcctacttgtccctatctccttgtccacacataaggcttggaaggcagccatgttgtatatcacgtgattgccaaccaatgagctgattggcttcttcaacaagagcccaggtagagattggtgtctagaggagcccatcagtttctagagaatcaggcctttggcagtggaaactcccctgggaggatgtcacagggtcctcagggtcagacacagagagaaggagacattgggacagagagaagaggcaagaaaaaaacataccttgcagtctgtgaggaacaaggtggcccctaggggcctccagcccaggttctgaatcaaagctcctcaaagtttaaggtgcatttggatcacctgaggatcttatgaaaataaactctgtctgattcagtaggtctgggtttgggggtgggagcctgttagtatatttctaacaagctcccaggcaaggctgctgctgctgctgatctaatgaccacagtttgaggctggacagagtggctcacacctgtaatcccaacactttgggaggacaaagcaggagggtctcttgaggctagaactttgagaccagcctgggcaacacagcaggacctcgtctctaaaaaacaagagagaagaagaaaaaggaaacaacaagaagacctcaactagaatatgaagcagctaggccacatatgtcttcaatggagaaaagagctttttcttgagtaaattggagtgtacccatgttccttgtcaatgatggtaactttaaatgtcaagaatgtgagagaggccaggggtggtggatcacacctataatcccagcactttgggaggctgaggtgggaggatcacttgagccaaggaattcaagagcaccctgggaaacaaagtgcgaccccgtctctacaaagtcaaaaaattagcccagattggtggcatgcgcatgtggtctgagctacatgggagggtgaggcagaaggattgtttgagcccaggtcgaggctgcagtaagctaagtttgtaccactgcactcattccagcctgggcaacagcaagaccctgtctcgaaaaaaaaaaagaatagtagagaccaggggaaggtgtgtccctggggtaggcgctgggagactggagaacaactgttagtggtcccatcactgcccagagcagacagtgccctgtccaccctcatgagatctttgaactccttggacaggactggctataaatgaaaatgtggggacccttatttttaacttgttaagaatgttaagatggcaacagcaaagctttaaaccaagtgcatggcccttctgcgttgtaggcccacaaggccgacactgttattcacatccttgtatggtcccctccccttgagtgtggctggggcctgtgctctactgcttggaagcaaggcttatccctaagccttattttcgggaaggtggatttgagagctactatcccacatccttgcttggtgccctgtgaataaatcttttctcttttgcaaaactcgtgtcatggtgattaatttactgtgcaatgccaggcactgttggaaacctctggataggcctcacagggcctcagccatctcagggaggcgttagctagagtgtaacaaatacgaccccagcaactggggagggacagctcattccttcatgaggtgtggggctggcagccccgcaggcagtcagccacccttcctctctggcctccgtcctgggcactgggcccaggcactgggcaaggaggctgctgcacctcctttctcctcttccttttttttttttttttttttttttttttttgagacggagtatggctctgtcgcccaggctggagtgcggtggcgtgagctcggctcactgcaagctccgcctcccgggttcacgccattctcctgccccagcctcccgagtagctgggactacaggcgcccgccaccccgcccggctaattttttgtatttttagtagagacgggtttcaccgttttagccaggatggtctcgatctcctgacctcgtgatccgcccccctcggtctcccaaagtgctgggattacaggcgtgagccaccgcgcccagcctctcctcttcccttttagtgggaaatatacctgcagcctagattcccagaaaggggtggtgagagagcagacacgccactgattgacccaaagttctaggatccaagggatgagtgaagagggcgtggccggactcggggctcctggtgaggtgcaccgctgcaggctgggtgacccagcagttcctgcccaaccctcacctacccccagccgttcctgtccgccgcccccaaccagccattcctgcccgcagttcctgttcccgggcctgtccccgggtttgtccccagggcccgtcccctgggtttaggtctgccctcccacgccccaccccattgcccccgccatgggtctgctgtcccagccctgccgttcagtctacatcttcgccaagaatggcatccccttcgagcttcgcaaagtggagctgaccaaagctgggctgggcaggcaggcccaggggatattggccgcggatccctgcctgtccccgctgctttgcagttgggccaagaatgcagactaacacgaagaatcagactctccggtgtggaaactattacataattatctatgttattatttttactttttggagacagcatctaactctgtcactcaggctggagtgcagtggcacaatcatggctcactgcagcctcgaccttccaggcttaagcgatcctcccgcctcagcccctcaagtagctgggactacaggtgcccacctacatgcctggccaatttattattattattattattgagaggaggtcttgctgtgtttccgaggctggcctagaactcctgggctcaagtgatcctcttgccttggcctcccaaagtgttgggattacaagcatgagccgccatgccccactggttgtctattttaatagaggcttgatctttgcttgtgaatacaaaacattcttcaaaatacaggtttagagagggcacagcaggcacagaacgagggtagggaaatggagtggggcaagaatatcttcaccccatgtgcttggaaaaaacaatgaaactgcctcgttgtttcctaagtaaaatagtccctgtctacccctgcctgtgtctcttccacttttgtattatttgtttatttatttatttatttatttattacagtgtctcaatctgcagcccaggctagagggcaatggcatgatcccggctcactgcagccttgacctctcaggatcaagtgatcctcccaacttactcctcctaagtagaatagttgggactacaggcacgtccccgtgcccagctacttttttctttggtgtgtgtagacgcatgattttgccatgtagaccaggctgaccttgaactcctgagctcaagtgatcctcctgcctcctccttctaaagtgttgagatcacagacatgcaccaccatgtctggccctgggtctcttccacttttatgtatttcttggcattcttctgccttttctttttcctgcatctgacttgctctatcccatggggcttctcacccagctgaaggggctactcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagagggaggaccctgctcagctgactcttcccaactgctgcccttggtacaaccagcttgagtcacctgctacagaacaggggctggacacagaagcagtctgtggagggagaatgggcaggggtgtgtatgtccattcagtagaagggcaaagaggcccacatgtaggcctatgatcagactggagcctggcttgactgaggtcctctgatccaaacaccaggcacctaatgcggcctctagcactggcctagagtgctaaagtgagtcagacctgggaacccccactggggagggagccttgagagtttggcataagaaagcaagaagagctgagccaccggaggctaagtagctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggagctggacacaggaaagatggccctctgatggggtcaaggtctgtgacccagtgactagcagagaggcttcctcttccctgatacctcccagataggggcctcagaaagctgctgctgggattttggggtgggggtgggcagagacctcagagaactctgggttatccccactcacctctctgatctttcctgcaggccagcagcacagcgatgcctttgcccaggtgaaccccctgaggaaggtgccgggccttgaaggatggggacttcaccttggctgagaggtaaccggtccgtgggctgctgccgggccttgtggggccagtcggctgtctgttcactgttgatggcttggatcatggactgtgggccctgcaccagccccaggttgaagaatgggtggaggcaggcagaggtgcccagtgttgacaagggttatagaagtcccctcctgcattgtacaagtgaggaaactgaggctggaggaggggagggacttgcacaaggccacagggcccagtctgcttccgggcctcctcaccgccagccttcccctccaaaaaaaggagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctgcgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgctgagggaagactccctgaaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcgggaggtcacgacagaggggagcatgggacactgggaaggctttggctcttaccgcaggtggattgagtcgttggagagttttgagcagaggagaactgtgatctgacttacgtcgtaaaggatccccctggcaggggtgagaaagccactgcagtcatctggcatgcagcgctggagccccagaccaaggtggtggtggtgcagggttgtgggggattgtggtcagttctgacttttattgaaatctaactgcagggtttgctgaagggttggaggtgggtgggaaaaatgaaagccaaaaccagcctccaggttggtggccgcatggtggcgtcctttaccgaggccacatagtgcctccttggtggagctggattcacattcagagcctgggatcactggatggtccaacacccataaaggcatgatgagctctgagggtcagactgcacaacccttcaccataggtgaacgggagttgggacagggtgggaagcaatgctgccatgtcacctggaaggctctgtccctgctggccttgctcctggccctgtccacgctttggatatgttggggagatatccaacttgctctcgttcttcagactcacactgggtgccccttcctcctggaagccttccctgagcccctgctgaagttcatgacattttgtttcttccttgctgcccttagttgagatgacagtctggccccgtgtagggctgtgtgaccctgggtagttacctaacctctctgagcctcacatccctcctctgcatcatggggatagtgaaaatgccccagaaaacggctgaagagtgttcagggcatgtcttctacccctgccatgtccccccagtgtggctagcttgctctatatgagctgcatgtacaaagcacctgaccactggtacctccaggacctgcaggcccgtgcccatggggatcagtacctgtgatggcagcacatggccctgcagagtagctgctgctgggccatgtggcagacggtgagccatggagggcagggacacctcccgggatgcccaagggatgctgctttcactttacaaaatcctgtttaaacctgagaccaaatcctggaatgccagagactgcctaattcacccaacttgtttcataggagggaaaccaaggaccagagccaaggaaggattcccctaatgtgccttaattccacagctaccacctgcacacttacactcacacactgttcgacacacagccacactcacacacacatctacccacgtccacccacagtcacacgatgtatcacattcacacatatacacccacacacacaatcataacatttacacacagtcacacagttaactcctatacacacatatacacccacacaatcacacaactcactcatattcaacaaagtcacacaactcactcacattgacacacatacacaccaaccccacacacaattcacatacatacacacacatatacacccacatacacaaccacaccattcactgacattaatacaaagtcatcacacagttcactcccacacacacacatacacctcacacacacaggcacacaattcacaccaacaaaatcacacagttcactcattcacacacatacacccacatacacaaattcacactgctcagtcacatttacacgccattcaaattcacacacatatacacctacatacacacagttcactcacatcacacacatatacacccacatacacacagttcactcacatcacacacatatacacccacacataaacacagtcacacaattcactcacgttcacacacacagttcactgacattcgcacacatacacacacaccacacacaggcaattcagtcacatggccgaaagccagtccttaccttcctacagttcctttcccagtgtcacctcagcctttggccctcagcgtccccttcccatgcctggactgctggagagccctgaacacaccccatcttcatgcctccagcgctagcccgagcccttccctctgccaagagcactaagtgcaactcaagatcacctctagggacccttccctgcccctgctgccaggtgacctgaggatcctgctggtcccgcttgacaatgatgcacagcatggttagttcagctgaggtcgctctcccagacttactgccacctacacagcactaggactgactgtttaactttattctttatttcgtgtactttattggagtgtctgttgaaagcaaaaccatccaataaggaacaatcccaaggcagccagcatggatcaagaaggcacaggctgtggccgccatccccagtgcctgatggggagagggggtggtaatggaaaaggcccaggaaagcaggccagagtgtcccccaaagtatgagaaatcactggaagagagagccagaatgggacctaagacagaagccaccaccaggcacccttaaggcaggacagttgcaatggttacttggaatacttccggctaggagtggtgttgcgggaagtcagggaccccaaacagagggaccggctgaagccatgacagaaaaacgtggattgtgaagattttatggacatttattagttccccaaattaatacttttataatttcttatgcctgtctttactgcaatctctaaacataaattgtaaagatttcatggacacttatcacttccccaatcaataccgttgtgatttcctatgcctgtctttactttaatctcttaatcctgtcaaccaaggaggatgtatatggcctcaggaccctgtaataattgcattaactgcacacattgtacaggatgtgtgtttgagcaatatgaaatgtgggcaccttgaaaaaagaacaggataacagcaattgttcagggaataagagagataaccttaaactctgactgctggtgagccaggcggaacagagccatagttctcttctttcaaaagcaaataggagaaatatcgctgaattctttttctcagcatggaacgtccctgagaaagagaatacgcaccaggaggtatcagcttataaacagcccccctgggcgtggcctgtctcttatggtcgaaactgcagagatgaaatatactccagtctcccatagcactcccaggcttattaggaagaggaaattcccacctaataaattttggtcagaccagttggtctcaaaaccctgtctcctgataagatgttatcaatgacaatggtgcccgaaacttcattagcaattttaattttgcctcggtcctgtggtcctgtgatcttgccctgcctccacttgccttgtgatattctattaccctcttaagtacttgatgtctgtcactcacacctgttcgcacactccctccccttttgaaaatccctaataaaaacttgctggtttttgtggcttgtggggcatcacggatcctaccaacgtgtgacgtctcccccggatgcccagctttacaatttctctcttttgtactctctccctttatttctcaagccggctgacggttaggaaaaataggaaagaacctacgtgattattggggcaggtcccccgatagagtggcacatgatgggcacagggcaggcttgggaaatggggggccgtaaggccacaagacatgtgggcaggtagcccagagtgtgtctggaacatcctgtttattggtcggcagtgacatctactgtcacatttgagaactgcatccacagccacatgacctcctgtgaagacctcagggcaaactggggaaacctgcccttcttggaaggtgatactaggggggatgagcaacacctttcttggaggtttgaattcctcagggcccctccagcatcttggtcttcctaattcctcccttgatcccccagccctaggggtggtagcttcttgtagtgtttacctccgtgttaatctggattctctctgtcttcggagttctctaatgcctggttaccaattctttatatcaagttctctccgttaaaatcattgtggtggggtccatcccatggatatacatggaggtctgtgtgacaatgtataatcttactatttgcagttattacaaaactgtcctagaagacatgaatgcttgttaaaagaaatcttttaagtttcctagacttcaaagaccgttgctatgccccgtgaaacatcgcctatatcctttaacagtttgcaattcgaattggttacttacttaacattttgttgccctggtgatacaattatgttgactcgttattgtgaggttactttgttattaaccatgatgaggattactagcacatacttttactccatatgtataacacaacaatgtagtaaaaccaataactcttggttctctattcaaagtgtttggaatctttattctgtttaaaacactgatgacatttgccaatttttgagtgttcttcatgttactgatttgtaggagctctttatatattgcagatttagtctcttactggttatgtatgctgcacctgaggagtagaagcactgccaaggacactgagtgtcttgtctgtgcagagcttcacatgaagctggagagaagggactggggcaagagggaaagataaaaaggggcaagtaagtaacagaatgaatccttgttgctaatctcctggcccccatcccagacccttcaggggatcctggcgattcgaagcagcatagcctgataggcctctggtgagggtgttgggagggttttcttggccgcctgttccaggatgctcaagatgatgctgtgggcctcctggcatagctcagcacccaggaaagcctccactcgtccacgccatgctgccagtcgtggccgtccctcaaacagttcatagccgagagccaccggctgtagggacaaggatgaaaaagttgtgggcatacaactttcccagttgtcactgccgacccgaatgctggaaccatgggcagaagtatcagagacatggtccattccccagcccctaagtgaatggaccacaggggcccaggcagtatgttcagccttagagcccaagagcagccagggtgagaccccacacccaggcaggaggcagaagttcagggttctggccccagatcatccagagacttgctctatgattctgggcaaagttctggctttctccaggcctcagtgtttctgtctgcctcatgggtgtgacacgaagagggacactgcccacaggctgagctcacacctgcatcagctcctccagggccatgagatcagccagtgtcacctgctggccagcgaggaagggcctgtcccccaggaacttgtcctccagccattgcagggcctggtccatggcagtcctgttgcgttccaccttctcctcgggcacctggaccccaatgagtggccccaacacctgatgggggcagacagtgggtcagtctatggccccgacctactgccaactactctctgatggccaatcactctccagatggctctcctcacctggacccacaggggtataccaaaggtgccacggatgcagtcggcatgccagcccaggtactcatgaacacgggcacgagcctgcaggtcagatggataccagtggtccggcgtctggtacttacagctcaggtaaatcaggatggccgagctgggaacaaatgggcagtggctataaggacactggcaccaggcatttacccctaactgctcccatctgccagtggggcccgggggcttctctgcatttgaaggactgccctccagcctcgccctccatctccagctccccaacaccacccactcctcctacgagtctcctcctgtctttgttgccttgggcaccgactcttggctggaccttctgctttgcattttgagaacctcatctctgtgatatgccagcagccgccctgtgaggtagagactcctgttagccttttagcacaagagaaaactcaaggtcagaatggtcaagtgacttgtccgaggcggtgcagctcagaataggctccctggacccctggaaccctgcatggggctggcacacagtggatgctccgtggagtcccttgcatgtccacgcgcttgggtcagggatcacgaggggaggaatgtctttggcccccgtctgacaggcccccagccatcacttctgcagccacctgacctcttgtccttttcctgcccagcagctggacctcaccatgagctgtgcccttgggccatggcattggcctctaggcccggcctgggtagattgggtagtctgcgacaagtcactagaggctcttttcagctagcatttgttgaacaaatgcgcaacagtggaaaaatgttcccttgtcttctcttctaatacccttcagtctgggagtggagaggccctgcggctcagaaaaggctgaagatgagagctggggggacatgttctgtcagcccctgctcatcccggacacaccccaagctgtaccttctccccagatacctctcctttctttctttccttttttttttgagacggagtctccctctgtcgcccaggctggagtgggctccctctgtcacccaggctggagtgcagtggcgcgatctctgctcattgcaagctccgcctcctgggttcacgccattctcctgcctcagcctccccagtagctgggactacaggcggccgccaccacgccctgctaatgttttgtatttttagtagagacagggtttcaccgtgttagccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcggtcaagatgaaatcaccatccttgagcgtcggcagtttccccaggctgttgatctgcaagaactccttgctcttgtgctgccctgaagaggaagaagtcagaaaaggtcttcagagtaaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagcatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatccctccaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcggtgtgggcagcagctgtggcaggatcccggcgcgccgggaaataggggatcaggccccaccccctggggacagcacccaattggagcgcaccacccccggacccgcctcgccccttcggttcctgtccagtcctgccggccaagactccaccaccagatccgtgcgtccctacagggagggcggtcgctatgaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcctctaaaagggatcttagagtttcacccagtgggatgtgacacttgcaggtgtcccaaactggtgggaaccttgactggaaggctggggtcaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccacctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttcttttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacaggtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagctt

SEQ ID NO: 3950 - DNA, 43058 bp, Homo sapiens
  Genbank Accession No. Z84721
gatcacgccattgcactccaccctgggcgacagagcgacgagaccccgtatcaaaaaaaaaaaaaagaaagaaagaaagaaaaaagaaaaaaaaaaggccgggcgcggtggctcacgcctgtaatcccagcactttgggaggccgaggcgggtgaatcacgaggtcaggagttcgagaccatcctggccaacatggtgaaaccccgtctctacaaaaaaaaaaaaaaaaattagccgggcgtggtggcgggcgcctgtaatcccagctactcgggaggctgagacaggaaaatcgcttgaacccgggaggcggagcttgcggtgagccgagattgcgccactgcactacagcctaggcgacagagcgagactccgtctcaaaaaaaaaaaaaaaaaaaaaaaacacttggaagccgacaggagatctttgagaccttgggcgaggcagtgacactaaaggcaggagcgactacagaagaataaattaaacttcatcagattaaaaactttactgcggccgggcgcggtggctcacgcctgaaatcccagcactttgggaggccgaggtgggcagatcatgagatcaggagatctagaccatcctggccaacatggtaaaaccccgtctctctactaaaaatacaaaaattagctgggtttggcggcgcctgcttctaatcccagctactcgggaggctgaggcaggagaatcgcttgaagccgggaggcggaggttgcagtgagccgagatcgtgccactgaactctggcctggcgacagagcgagactccatctcaaaacaaaacaaaaacttcggtgctttaaaggacaccatcaagaaaattaaaagtccacccacagaacgggagaaaatatttgtaagttacatatctgataagggaattgtatctagaatggaggaaacttacaactcaacaataaaaagacaattgaaaaatgcacaaaggatatgaatatttttccagtgcattatgcaaatggccaataagcaccagaagatgctcagctcaactggtagaggcttacgcctgtgaccccagcgctgagaggccaggaactccagaccagcctgggcaaaacagaaattaaaaatgctcaacattattaggcattagggagatgcaaatcaaaactacaaatagatgccacatcacacctcctacgatggctgtaatcaaaaagacaagcgtcagcaggggtgtggagaaacgggaatctctctcctgctggtgggaatgtaagaggctacactcgctatggaaaacaggctggcagttcctgaaaggttagagttaacacaacactcggcaaatcccccttttagatatatagccaagagaaatgaaagcatatgtccacacaaaaacatgtgtgttcttagtaatattattcataatagcccaaagtggaagcaatcctagggtatatcaattgatgaatgggtgaatatggtatagtttgtttaagggaatactattcagccataaaaaggaatgaagtacggcacatgaatccatcttgaagacacactaatatatgattccatttatataagatgcccagaataggcaaatccatagagacagaatgattagtggctgcctagggcttccagggggtcaggggaaatatggagcgattcatgggttttttgaaggggagtgatgaaaatgttctaacgttgactgtggtaatggttggacagctctgagaacgcgaatacactaaaagacatggaagtgccgggcgcagtggctcatgcctgtaatcccagcgctttgggaggccaaggcaggcggatcgcgaggtcaggagatcgagaccatcctggctaagacagtgaaaccccgtgtctactaaaaatacaaaaaattagctggacatggtgcgggcgcctgtagtcccagatactcaggaggctgaggcaggagaatggtgtgaacccgggaggcggagcttgcagtgagccaagatcgcaccattgcactccagcctgggcgacagagcgagactccatctcaaaaacaaaaaaaagatatggaagtgtacacttgaagtggataagctttatggtatgcaaattggtatggtatggtaaattatatctcaatgaagttgttttttaaaaaatcaccccacctaccctatcccaggcttccccaggaggtaactaaaggtaatgagcttctttggctgcttccagaactttcccaagcacatcaaatgcatcagaacctaaccacttgactgagggatgagcattttcactgttgcaagtaaccctcttgcaccaacactgacactaatgtgtattttgcagaacaaatttgtggattggcctcaccagggtgaagggtacgtgcatttgaaatggctcaacagtaccaacaggtgcgttttcttgcacagggctgcataacattttttttttttttttgagacagagtctcgctctatcacccaggctggagggcagtggcacaatctcagttcactgcaagctccacctaccaggttcacatcattctcctgcctcagcctcccaagtagctgggactacaggtgcccgccaccacaccaggctaattttttttttttttttgagatggagtcttgctctgtcgcccaggctggagtgcagtggcacgatctcagctcactgcaagctccacctcccaggttcacaccattctcctgcctcagcctccccagtagctgagactacaggcgcccgccaccacgtccggctaatttttttgtatttttagtagagacggggtttcaccgcgttagccaggatggtctcgatctcctgacctcttgatccacccgcctcggcctctcaaagtgctgggattacaggcgtgagccaccgtgcccggcctgcataacatttttttttttcctgaaattcccagaaaggaaaatggtgtcttgttctatgttgcatttctttgattgagagggagagctgcatcacttaattatttgcagagaattgcttttcttgttttctttacaggtggtctgttcttggatggtctggctgtgttctttctgaggaatacataacctctgctacacattttgcaaggctttatccccgttgtccatgttttgattttatgtataatcaaaaggtttgtgagttctcccgcacttcccaggagtgcctctgggatggaaatgagactgcaggagcagggcttgaggctggaggggtgagatgggacagatgggggtgggggaacccagggcagtggccggtggtggtaatggaggcctcctcacagggaccctcacagcgaccatgcgaatggagcaggactgtgactcaggtctcgctcttctgacctaatcgtgctgctgccccaatgggcagaaccttggggctccagactggacatctctgggctcaaaggatcccactgttcccccggttaccctctcagggttggcctcctgccagtaaccctggcactcattgttcattcttctgactatcgtcagtcataatgagagctcgaactggtgaaagtgcagggagctcaccatgaccccagcccacagaggtcctgggtgcgtccctgccctcgaagcagcactctggatcccagcgccaccctcatgtccatgtttgcacctcattggctgtgacagaaatgagacatcattgtcacacgctggcctgagggtcagtgggccttgctttggacctcagtttccccaccagtaacagggttcagagcagatggtccctgagtgagtcccagctctaagttctcccagggtctcctggacaatgaagcaccagggccaacctccatttgctacaggggacatcctcaggctcttctctgctaagaccccacacctccaagtctcctcattttacctttaaatagctgtttcatgacctgcttttttgacggtaagtagatttttggaaactgaaacccctgacccttcctcccagcctgggcctgcccttggcaggataggaggccttatcggtcctgccacttggtctgggcctcaaagggccaccgccatctgcaggagggccgggtggggttcacagacgctatctgggacttgcctggacacctccaccttctcagctgagtgttgctgccccaccagggagaaccactcacacacagtagtaatagaaataatttaaaattcatgctgcaagttcctgagcgccctcccaacactgaggtgggggctagtctaatccccatcctagaggtgaaaacagtgaaactaggactcacaaggcaaattagcctgttcagggtcaccgagggtccactctcatgggagagtttgcagatgcccaatccggcattctgctgagtgtccagtggcttgtaagtggccagacaccctttgagctcagcctcagctgctcaggcacagaacgtgcctggagcttggaattcaggccagaaaccaccagtggacaccagcattccacactcactgcacaggctggggctcaaaccaaggcccagggacaggaagggacaagccccagccccagccggactcccagcccacacaaaccatcagggcttgtttcctgctccatggaagcctcagacatgtttcataacctcctggagcctccgtttccttatctttccaatgtaatgatgcccatgtgcagtggctcacgcctgtaatcccaagcactttaggaggccgaggtgggtggatcactggagctcaggagtttgaggccagcctgggcaacatggcaaaacgccatctctactaaaaacacaaatattacccaggcatagtggcacatgcctatagtcccagctactcaggaggctgaggtgggaggatcacctgagcttgggaagttgagcctgcagtgagccaagattgtcacactgcactctagcctggaggacagagtaagaagaccctgtaacaaaacaaaacataacaaaacaaacaaacaaaaaacccaactaatgacaataaaataaaccctccctcacagggtggttgtgaggataaagcacccagaatgaagagtgttgctgccatgtgcagaacttagaaagtgctcaacagatgccagccaaacagacatggactcccctcaacacagtcaacccaaggttgactgtcaccaaacgcaaaagaccacactgtaaagcttttagaaatgtggtctagtggccgggcactgtggctcatgcctgtaatctcagcactttggaaggctgaggcgggcggatcacagggtcaggagttcgagaccagcctgaccacctgaccaacgtggtaaaaccccgtctctactaaagattcaaaaaattagccgggtgtagtgctacgtgcctgtaatcccagctgctcgggaggctgaggcaggagaatcgcttgaacccaggaggcggaggtacagtgagctgagatcgcgccattgcactccagcctgggagacagagagagactccgtctcaaaaaaaaaaaaaaaaaaaaagttagccgggtggtagtggcatgtacctgtaatcccagctacttgggaggctgaggtaggagaatcgcttgagcctgggaggtagagggttgcggtgagccaagatggcgccactgcactccaatctgggcgagacactgagaccctgtctcaaaaaaaaaaaaaaaatgtggtctaggagactctcttcactttgagataaaatttgcatcacgtaaagataaccattttaacgagagcaagtcaacggcattcagcacattcagagtgttgtgcaacaaccacttctccctggttccaggacattttcatcgcctcagatggaaacgccctcctcacggaggcatctctcccggcctttgtcctccccggccctgacaaccactaatctactttctgctgggatttgcccattctggatgtttcctaaaaatggcttatctaagccccacagtttcatgcagcacgtagcctctggtgtgtgacgtccttcacttggtgtaatggttcgaggcttgtccatgtcgtagcctgggtcagaacttcattttcatggctgaataatatctcacggtgtggaaatatcacagtttgcttatctgttcatccagtgatggacatttgggttgtttctaccttttggctattgggaatggaagggataacattttttaattggatttttaaagtcactagtttgactgcattaaaattacaaacttttgtttaacgagaatatcactaagatacagagttggggagatctaacacataaaagtgacaaaggaattatatccagaatatttttgaaatttctacaaatcagtgactggcaacacagtgggaaagtggccaagactaaaatactttaataaagaggaaaccgaaatggccagtaaatatgggctcaacctcactaattatcaggaaaatgtaaattaagaccacaagagaaaccactacacactcaccaaaaatcacacacccaataaaaaggtaatttttttttttttttgagatgaagtctcactctattgcccaggctggagtacaatggcgcgatcttggctcactgcaacctccgcctcctgggttcaagcgattctcctgcctcagcctcctgagtacctgggattacaggcgcacaccaccacacccagctaattttgcatttttaagtagagacggggtttcaccatgtgggcaaggctagtctcgaactcctgacctcgtgatctgcccgccttggcctcccaaagtgctgagattacaggcatcagccactgtgcccggcctaaaaaaggctaaaatttaagaagaccaggagtttgactgctatggttggaatgtttgtctcctctaaaactcttgttgaaacttaatccccagtgtggcagcgttgagaggtggggcctttggggtaaggaggttggatcatgagggtcctcccccaaggaatggattaatgagttgtcatgggagtgtggctggtggctttataagaagagagacctggccgggcacggtggctgacacctgtaatcccagcactttgtgaggccgagatgggcggatcacaaggtcaggggatcgagaccatcctggctaacacagtgaaaccctgtctctactaaaaaaaaaatgcaaaaaaattagccgggcgtggtggcgggcacctgtagtcccagctactaggaaggctgaggcaggagaatggcgtgaacctgggaggcggagcttgcagtgagccgagatcgcgccactgccctccagcctgggcgacagagcaagactctgtctcaaaaaaaaaaagaagagagatctgaggtggcacacaagcatgctcagcccacacgacctgcgattaatactctgtgccactttgggactctgcacgagtccccactgggctcgaaacttctcagcctccgtaactataggaaataaattccttttaaaataaattccacagtctcaggtattctattataagcaacagaaaatggagtactacaccgatcatatcaaatgtttagaaggatttggagcaaggagaatgctcgcacaccactagggaaaacataagttggttaaccactgtgaaaaagtttggcattctttactaaagttgaaaatctatatgccctatgacccagcaactttactcctaggtatgtatgtacaaaatagaatttcaggcatgtgggtaccaggtgacatgtaaaggaatgtttattgcagcattattcataatagccaagaactaaacaacacaaagttccagccccagtacaatgaataaactgtggtatattcctacaaggaaatattaatagatacagcaatgaaaatgaacacatataacatggctggtaaatctgacatgagagagtgaaagaagatggacattcagtgtgcagacagttggattaaaaatatttttttaaaggccaggcttggtggctcacatctataatcctagcacttacagaggccaaggcgggcagatcacctgaggtcaggagttcaggaccagcctggctaacacagtgaaaccccatctctactagaaaatacaaaaattagccaggtgtggtggtgcatgcctgtagtcccaactactcgggaggctgaggcaggagaatcacttgaacctaggaggcggaggttgcagtgagccaagatcgcatcactgtactccatcctgggtgacagagcaagactgcgtctcgaaaataaatagataaataaataaataaccaacaggccgggagcagtggctcatgcctgtaatcccagcactttgggaggctgaggtgggcagatcacgaggtcaggagatcaagaccatcctggctaacacagtgaaaccctgtctctactgaaaatacaaaaaaattagccgggcatggtggcgggcgcctgtagtcccagctactcaggaggctgaggcaggagaatggcatgaacccgggaggtggagcttgcagtgagccgagatcatgccactgcactccagcctgagcgacagagcgagactccatctcaaaaaaataataattaaaaataaataaattaaataaataaataacagattgcataaagtggctcatgcctgtaatccaagcactttgggaggccaaggcagaaggatcacttgagcccaggagttcaggacaagcctgagcaacatggtgaaaccccacctctacaaaaaaaaaaaaaaaattagctgggcatggtggcatgtgcctgtgatcccagctacttgggaggctgaggcaggaggatcacttaagcctgggaggtcgaggctgcaatgagctatgatcgtaccactgcactccagcctgggcaatagagcaagaccctgtctcaaaacaaataaacaaaagccagacagacacaaatgagagcattctgtatcgtttcatttctatgaaggtgaaaagcaggcaaaaacaaccaaagtgcttgcagatgcatatctgagtagttaaaaacttactgaaaagcaggcctggctcacgcctttaatcccagcactttgggaagcgggcggatcacgaggtcaggagatcgagaccatcctggctaacacggtgaaaccccgtctctactaaaaatataaaaaattagccaggtatggtggctagtgcctgtggtcccagctactcgagaggctgaggcaggagaatggcatgaatccgggaggtggagcttgcagtgagctaagatcgtgcaactgcactccagcctgggcagcagagcgagactccctctcaaaaaaaaaaaaacttactgaaaagcaagaagtcaggtggaggttacctttggggaggattggggtgctgtccgctttctaataattcgttaaactatagtctacatcttgtgctatatttcacaatggaaaaacagaaaagagctcctgcccataacgctgctttgcaggtttggaaatttcagattcaattcctctccttgcgggggccaaggatgggaagagcaggtggttccagtagggaaagaggaggccctggggcctcaaaatggctaaggaccattcctcagcgtgggtggcacctaccctggaaacaggactctacttcctcctctgttagggggcagagcagccctgcagtgccttctgggcacaggtcctcactctgcagctggaggaattctcccaggcactgagagcccttcacggcccaaatgccccgtgcgctcggcctctggacttgccttccctgctctgtatatctccctccgcctgaccctcagcctcctccatcactcactgtcttctctgccagtctattcatctgtctctgtccctctctctgccaccttctctcctattgagaagccgaaacctcaggcacagacccacatcccctcctcatgggcccatgtgcccaaggtgcccctaggtgccaggctgagatgaaccaggagtgtccttctgaacccagcaacagcgaagggtgaccagggagggccagttcatctcggtctgaaagaagccccagatgagcaaaggatacactggcctcctgcggtcagcagcacttcccaggacagtgagcaagacaggggtaaggccagagtgggtgggcacacccatgggagagaggagccgctgtgaaatgtgcacgaggaacagaccagcaaggaggatccacgcagtgctagaagggagttcctggaagcctggtggagagcccctcccatctgctaagcccggagggcatcaaaggctgctgctgccctcaacccctgacaatctcatcatctcatatctcaggcatggaagaatgagggccattacacgagtaaaacatcaagtacactccagcctggatgacagggccaggctccatctcaaaaaaaaatgcctgtggtcaaagctctcctgacaggggaaaacaaaacaaaacaaacttctccttaaagaaaacatttgcctttgactgcatcataattccagcaggattttgtgcagataactctttggctaactctaaaattaatacagaaaggtaaagaaattagaatagccaaagaaattttgaaaaggaagaataaagcgagaggaatcacattcctcaatttttaacagctctattgagataaaattcacataccatacggttcacccatttaaagtgtataattcaggccgggcgcggtggctcacgcctgtaatcccagcactttgggaggctgaagcgggcagatcacctgaggtcgggaattcgagaccagtctgaccaacatggagaaaccccgtctctactaaaaatacaaaattagccaggcgtggtggctcatgcctgtactcccagctactcggaagactgaggcaagagaattgcttgaacccgggagacggaggttgccatgagccgagatcgcgccaccacacccagctgccattttttaattgattacttgtctatttattactgagttgtaagatattttgggccaagcacggtggctaacgcctgtaatcccagcactttaggaggctatggtgggcaaatcacttgaggtcaggagttcgagaccaggctggccaacatggcaaaacaccatctctactaaaaatacaaaaaaattagccaggtgtggccaggcgtggtgactcacgcctgtaatcccagcactttgggaggccaaggcgggtggatcacctgaggtcgggggctcaagaccagcctgaccaacatggagaaaccccgactccgctaaaaatacaaaattagccgggtgtggtggtgcatgcctgtaatcccagctactcacgaagctgaggcaggagaatggcttgagcccaggaggcagaggttgtggtgagctgagatcatgccattgtactccagcctgggcgacaagagcgaaattctgtcacaaaaaaaaaaaaaccattagccagccatggtgatgcacacccgtggtcccagctactcaggaggctgaggtatgagaattgcttgaacccaggaggcagaggttgcagcgagccaggattacgccgctgcactccagtctgggtgacagagcaagactctgtctaaaaaaaaaacaaaaacaaaaaagatattttgtatgtgtttggataacttccctatcagatatatgatttgcaaatatgtttctctcattctgtgagacatcattcaattttaagacatcacagagctatgttaatcaaggcactgtggctgtggtaaaggatagacacacagaacagaacagagagcccagaaatggacccgcaaacctatgccccattcattttttacaaataagtgcgagaagccaactgaatagaaagcgtatagctttttcaaaaaacagtgctggaacaattggacatctgtaggcaaaaaaacaaacaagcaaacagaagaatctggacctgcccttcacacctcagacaaaagtcatctcaaaatggattgtagatctcaatataaacataaactatacaactttagaagaaaatataggtgaaactctttgtgttctgtggttaggcagacagttcctaggcatggcactaagtaagattcatttaaaattttttgacaaattggactttattaaaacttttgctctacaaaagacaatattaagagaatgaactaacaagctacaaactaagagaaaacatttgcaaattgcatatctgacaagggattgcttccagacgatacacagaattctaaaaattcatccttaagagaataaaccacccaatttttaaatgggcaaaacaggccaggcgtggtggtgcacgcctgtaatcctagcactttgggaggccgaggcaggcggatcacaaggtcaggagattgagaccatcctagctaacacggtgaaaccctgtctctactaaaaatacaaaaaattagccaggcatggtggcaggtgcctgtagtcccagctactcgggaggctgaggcaggagaatggcgtgaacctgggaggcggagcttgcagtgagtggagatcgcaccactgcgctccagcctgggcaacagagcgagactccgtctcaaaaaaaagacaaaatacttgaaaagatattggctaggcgcgctggctcatgcctgtaatcccagcactttgggaggccaaggcgggtggatcacaaggtcaggagttcaagcagcctggccaagatggtgaaaccccgtctctactaaaaaaaaaaaaaaaaaaaaaaaaaaaattggccgggcacagtggctcatgcctgtaatcccagcactttgggaggctgaggcaggtggatcaggagtcaggagatcgagaccatcctggccaacatggtgaaaccccatctctatgaaaatacaaaaattagccagagatgatgccgggtgcctgtaatcccagctactcatgaggctgaggcagaagaatcacttgaaccagggagtcagaggttgcagtgagctgagatcgcaccactgcactccaccctgggcgacaaatcgagattccatctcaaaaaaagaaaaaaaaattaaaaggaatatttgcctcattatgttacaataactaatatggaaagcaatattgcaatgcctattagcacatgacattaggtgaattctcctttgtccccggacctgctgcctcctcctgcttgtcaggggacagatccagtacatctcccctcagcgctgggtggacctaacccttgctttcttggaggaaacccaggaatccagagacaaagtggaagggtactggcatgtggttgggcagggctgcctgaggtcggtgtcagccgaccgtggggcttggtcccaggaggctgcttactgggccctgctcctctggtttcccccaagtcgtgattctgaaatgaataaggacggtgcagaactggactacaaatgcaggagtgacttcctgggagggtggggcccctatctctcctagactctgtggtcagactctggccaacaccccctgtaaggccacaggagaggaacaggagtgatagcccccaaaccccagtcccaccaggccctgagggcccctttgtcactggatctgataagaaacaccacccctgcagccccctcccctcacctgaccaatggccacagcctggctgggcccagctccctgtatataaggggaccctgggggctgagcactaccaaggccagtcctgagcaggcccaactccagtgcagctgcccaccctgccgccatgtctctgaccaagactgagaggaccatcattgtgtccatgtgggccaagatctccacgcaggccgacaccatcggcaccgagactctggagaggtgagtgtcagacgggactgccagagggactgggtgggaggccaggtatgtgagtggggacagtggggagggggcggtggggaggggacagtggggaggggaccatggagaggagacagtggggagggcactgtggggagaggacagtgaggaggggaccttggggaggggacagtgaggagggaaccgtggagaggggacagtgaggaagggacagtgaggacagatagcgttccctctcagtgaggagagcagggtaaggagggaacgattaggagttgcacaaccatctgggctcgctgagacctgggcaggcacaggcccaggttctgacaagcagagggtgaaaggtttcgttctaggcctgaagggccttacagggcagccagggcactacagcctctaaagtcccagcatctgggatcagggcactgtcccagcttcaaattcccagcatctgatcccctgggaggggccagggagcttttccttccctggaacgctgctgggaggtcatgagcctgcagaaggggtggcgggcaacccagtctggggctgggagggaggtcctgtggccagaggagacggtggaggggctgggggcaccaggcgtgctggaggcggagggcgggagatttggggaccaggctgcacagaacccgtcggaagcagggcgatcagccgggagctgcagaggcctggggggcctctagcccagggcagcctgggaggggcagctgcctgggcacccgggccccgcgaggaggggctggggcctgctgcggggtcgcagatgtgtcccggtgctcggagagggccgcagggcgcgtgggccgtggcgggaggccgcgctgctgggagctcacggcccccgccccccgtcccaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaaggtgcgcggggcgcggtgcgggcggggcgggacggggcggggcgcggtgcgggcggggcggggcggggcggggcggggaggggcggggaggggcggggtcgcggggcggatgcgggggtcgccgggcggggcccgggctaggccccgccccctcactgagccgcccccgcccccagctcctgtcccactgcctgctggtcaccctggccgcgcgcttccccgccgacttcacggccgaggcccacgccgcctgggacaagttcctatcggtcgtatcctctgtcctgaccgagaagtaccgctgagcgccgcctccgggacccccaggacaggctgcggcccctcccccgtcctggaggttccccagccccacttaccgcgtaatgcgccaataaaccaatgaacgaagcagcgtccacctggtctctgttgtccgtgggcggcgggcgcttggggaggcggagcgggaggagggcgccccggctgtctcggggccactgctgggccgcagggatccttgcaccgaccccagggtctctaagaggcagagggatgtgcagctcccggggcgggagcgggggtcactcgggacccaggcgtggtggagaaggggtgcagttaggcctttgcggaggggggagcagtgctggcgcccacccgccgcggctctccctgggacctccgtggtcttccttctttatttctcccgaatgtgtactatttcctgatttcagaacgatcaggacgaagaggggagggatgggcgtctgcgctcactcattccttcttccattcctcaatgaaacatttactgggcataagacagcctaggcatgtttctaggctatggataccgcagctgaaataaagaaagccctctgccccgtggggctgacaatctagtgggggatacagacgtgatgaagacagtcagatcacagttcacagaaatgagacaggaaaagaggctgagcctcactcataagagaaacgcaagttaaactacacaaaaataaaaaacctcactgagatccatgtctcacctccctgataggcaaaaatccaagagtttgatcagactgcaggcgcccctcctccactgggcacccctcatccagggcagagggaaccagcccggggcgcaagtccaccggggcatctcatttgctaaagacctgaaaacccaggtgtccatcatcaggactaactggaaaaaccaagggtatccgcaccatggagagctcgactgaaaaaaaaaaatgaggataattggataatttctttttttttttttttttttttcagacggagtctcgctctgtcgcccaggctggagtgcagtggtgcgatcccggctcactgcaagctccgcctcctggtttcaagcgattctcctgcctcagcctcccgagtagctgggtctacaggcgcccgccaccacggctggctaattttttgtatttttagtagagacggggtttcaccgtgttagccaggatggtctcgatctcctgacctcgtgatccacccgcctcggcctcccaaagtgctgggattacaggtgtgagccaccgcgcccgacctaaaatgaggataatttctaataatgaaaataaagaggttagaatggtgtgtatacaatggtggaacagaggagaaacacgaatatgtgtgtgcacatatatgtgagcttatgcataactatgtatgaggctgcgtgtggacatgtgtgtttgtgcacaaccatgtatgtgcccgcatgtgcttatttctgcaaaaataaaccatggcaggacaaaccggaaatgaatacaaataataaggtgggtggggatggaggggaaggtggaaggaagctcctgcaagtctgactctctacatagttttgacctttgatttgtgtaaatattttacattatcaaaaataaattcaggctgggcatggtggctcatacctgtagtcctagcactttgggagtccaaggggagaggattgcttgaggccaggagttgaaggccaccctggccaacatagagagaccctgtctttaaaaaaaattacaaaattaaggccgggcgcggtggctcacgcctgtaatcccagcactgtgggaggccgaggtgggcggatcacgaggtcaggagattgagaccgtcctggctaacacggtgaaaccccgtctctactaaaaagtagaagaaattagccgggtgtggtggcgggtgcctgtagtcccagctacttgggaggctgaggcaggagaatggtgtgaacccgggaggcggagcttgcagtgagccaggttcaagccactgcccttcagcctaggtgatagagtgagactccttctcaaaaaaaaaaaaaaaattacaaaattaataagattaaaataaaaagaggggccttgccagtggctcaagcctctaatcctaccacttgggaggccaaggctggaggatcccttgatgccaagagtcggaggccagcctaggtaacacagcaggacctcgtctcaaaaagattaaaaaattaactgggcatggtagcctccaaattgggggttagcctgggaggtttgcccaggaaggaattcaagggcaagctggtggtgttacacagcaactctgattgatatcgaagccacagcagacagcaggagcagaacactgctccttacagagcaggggtaccccataggctgtgtgcacaggagagcaactcagaggcactgctgcactcatctttatacccacttttcattatatgcaaattaagggaaagttatgcacaaatttctaggatgagtgtggtaacttctgggtggtccagtcactgccatggaaagggatggtaaactcccatggcacactggtgggtgtgtcttatggaaagctgcttctgccctacttgttttagctggtcctcagtttggtccggtgtccgagcccaacatccggagtacatgcagagtcccacctcctacgtcacacctgcagttccagctactcaggaggctgaggctggaggattgctggagcccagatgttgaaggctacagtgagctatgattgtgccaccgcacttcagcctgagcaacacagcaatactctctctctaaaaaagcaaagcacacaaacaaaaagagtgactgggtgcagtggctcacacttggaatcttagcactttgggaggccaaggtgggatggtcacttgagcctgggagttcaagaccagcctaggcaacatagcaagactttatctctactaaaatatatatatattttttaattagctggacatggtggtgcacctgcagtcccagctacttgggaggctgagttgggggtggaggggagtatcacttgagcccagaagttccaggctgtagtaagctatgattgcaccactgcactccagcctgggcaacagagagagaccttatctatatttaaaaaaaaaaaaaaaaagagagagaaaattgaaaactcctaattgaaaacccccaaattgaaaactaacttaaataaatgagccaatgtaagaatgtggtgatataataatcagaaaaaaggattgttccaggtgacctctgaacacagaacctcggctatgaccgaaagaactccaaagacactctaacactccgtggtttattgttcctcataacatatataaaataatttcataagcttttattttgaaacatattcagattatgaagaaataaaaacaccctgcaagaataagacaaagatggagaaggaaggatgactgctggtgggtttggggcttttggagggtgatggaaaccttctaaaattgattatggtgatggtcgcacaattatgtgaacacattaaaaattattgaaatgggccgggggtggtggctcacccctgtaatcccagcactttgggaggccaacgcgggcagattacctgagctcaggagttccagactaacctggccaacatggtgaaacccccgtccctactaaaaatgcaaaaattagccacgcatggtggcacatgcctgtaatcccagctactggggaggctgaggcaggagaattgcttgaacccaggagacagaggttgcagtgagccgagattgtgccactgaactccagcttggccgacagagtgagactctgtctcaaaaaaaaaaaaaattattgaaatgtacacattaagtgggtgaattttatctcaataaaactgttaaataaaataacaagaatatgaaaaactcttgaatactactcatccagactctccagctgttaacattctaccacatcggcttgctctctcttgcccccacttgctctttctctcggagcccttggagaggggtatgcaaatatccgtactctaaatatcctccatatactgtgtatttcctaaaatcaacaaggacattaggctgcacagccagagaacaaccatcaaaatcaggttaatattgatccaaatccatctatcaacagaagcaacatcaagttcaagacccttttgaaagcaatgataccagccatttactccatccctaaaggactgagggtgctgcgaatttaaccgtatcaatgcagtctttttgatgttatttactgaaggaaatggatgttctttaaaatatgtatttatttatttttcttttttgagacggaatcttgttctgtcgcccaggctggagggcagtgggacaatcttggttcactgcaacctctgcctcctgggttcaagaggttctcctgcctcagcctcccgagtagctgggattacaggcgcgaaccaccacgcccggttaattttggtatttttagtagaggcggggttttaccatgttggccaggctggtctcaaactcctgacatggtagcctgtaatcccagctactcgggaggctgaggcaggagaatcgcttgaacccaggaggtggggttgcagtgagccaagatcgtgccattgcactccagcctgggagacagagcgagactccatcaaaaaaaaaaaaaaaaaaaattcctgaagctcctcttgagcttacattctagtggactgtaaacagaaacatttttttttcctgtggataaagaaaagcagggcaagtaggggcttagacagaggaggggaggattcagattttaaatgggttggccactgtaggtctattaacgtggtgacatttgagggagtggcaatactagggaaggggcttcaggggagtggccaggagctagggatagagggagggaggacaggaggccttgtctgtcttttcctccatatgtaagtttcaggagtgagtggggggtgtcgagggtgctgtgctctccggcctgagcctcaggaaggaagggcagtagtcagggatgccagggaaggacagtggagtaggctttgtggggaacttcacggttccattgttgagatgatttgctggagacacacagatgaggacatcaaatacatccctggatcaggccctggggcctgagtccggaagagaggtctgtatggacacacccatcaatgggagcaccaggacacagatggaggctaatgtcatgttgtagacaggatgggtgctgagctgccacacccacattattagaaaataacagcacaggcttggggtggaggcgggacacaagactagccagaaggagaaagaaaggtgaaaagctgttggtgcaaggaagctcttggtatttccaatggcttgggcacaggctgtgagggtgcctgggacggcttgtggggcacaggctgcaagaggtgcccaggacggcttgtggggcacaggttgtgagaggtgccctggacggcttgtggggcacaggctgtgagaggtgcccaggacggcttgtggggcacaggctgtgagggtgcccgggacggcttgtggggcacaggttgtgagaggtgcccgggacggcttgtggggcacaggtttcagaggtgcccgggacggcttgtggggcacaggttgtgagaggtgcccgggacggcttgtgggacacaggttgtgagaggtgcctgggacggcttgtggggcacaggctgtgagggtgcctgggacggcttgtggggcacaggttgtgagaggtgcccgggtcggcttgtggggcacaggttgtgagaggtgcccgggacggcttgtggggcacaggttgtgagacgtgcccgggacggcttgtggggcacaggctgtgagggtgcccgggtcggcttgtggggcacaggctgcaagaggtgcccgggacggcttgtggggcacaggctgtgagggtgcccgggacggcttgtggggcacaggctgtgagggtgcccgggacagctcgtggggcacaggttgtgagaggtgcccgggacggcttgtggggcacaggctgtgagggtgcctgggacggcttgtggggcacaggttgtgagaggtgcccgggacggcttgtggggcacaggttgtgaggatgcccgggatggcttgtggggcacaggttgtgagaggtgcctgggacggcttgtggggcacaggctgtgagggtgcccgggacggcttgtggggcacaggctgtgagaggtgcctgggacggcttgtggggcacaggctgtgaggatgcccgggacggcttgtggggcacaggttgtgaggggtgcccaggacggcttgtggggcacaggctgcaagaggtgcccaggacggcttgtggggcacaggttgtgagaggtgcccgggacggcttgtggggcacaggctgtgagggagcccggcacggcttgcagctacagggagaaaagacttggtgctgtgggcctgccttggggctggtggtacagcccttatctgctgccctcaggatctcccggcccctctcgtccaggcccctgcaaccccatgccccagcctctgaggaccaaaggcgcccctgcttgggaagagggggctcaggggagtcgcctgacccggttccaagccaggctgatttaccgttgctaacatcctatcgcacgcatccctctgcctcatgcacccaaccccaaggcctggtacactgcaggccccaaggtcctgtgcgtcctttcaataccctcctcacctgcctcacctgccccccctaccctgactctggctggagaccccctccagggagttttcaaaacaaagggtgtcagtctcctgtgggattccctcacctctgcagcctgcggtctgaaagctgccccatggtgtgtagtgctaaacttccaacttactccaggccagcggtgacagcccgagggcaggaagggcacccacactgagcctcaaacagctaattttgcaactgtaagtccatataattgtcttgaaaagtaatttgtttcaaaaagctaaaaaacgaatactcttgagtctccttctagtaattccccttctagaggtctatcaccaggaaaagatccaaagcactgatattcttcatggagttgtttataatagaaaaaaactagagcttgttcacaaaggggagctctgcaggctgaagatgttgcacctgtcagcggggatgggggcacgcttgctgacgcagcaacggaaaagcatcagtgtgtgaagatgcattttctctctttctattattattatttttatttttattttttctgaggcagaacctcgctctgtcacccaggctggagtgcagtgatgcgacctcatcacaaccacgagccaccatgtgcggccccatgagcaagccaccacgcccagcctttttttcccttgttttaaaaaatcctctatttaaaaaagatgtgcatgggccgggcacggtggttcacgctcataatcccagctctttcagaggccgaggcaggcagatcacctgaggtcaagagttcgacaccagcctggccaacatggtgaaattccatctgtactaaaaatacaaaaattagccaggccgtggtggtgtgtgcctgtaatcccagctactcaggagactgaagcaggagaatcacttgaacccaggaggcagaggttgcagtgggtcaaaatcatgccaccacactccagtctgggagacagagcaagactccatctcagaaacaaactaacaaacaaaatttttatatctacctataattcgtataaatttaaaatacatgcataaaatcataccctttgcaagcacacgtactaactaaaaggaatatattcagcacatagaaatggttgtctaacggaggaggggggagttaataaacagagaggataaaaagaaataaatcagtagagctggaggagggtctcctccaggctgcgatgagaacatagtgagcagaattgcaggcctgcatgacctcaccttctgtgaggagtccggcctcccaagacgctttcctgcctaggtgcccggctcagagtgtcccctacaaggctactggaggagaaccccagaccgagcctcattcaggtgagggggctgcacaccggaggtgggagaggtctgtcccttcccaccctgtgacactgggtcccactttctctctagggggtctcggtttcctcatttgcaaactggagctcataaggtgggccagagaagtttcagtgaagtgaggaatggatcgtccctctgccagggcccatgtgctctaggtcaccctgtcatcacagggacagggaggtcaaggacagtcactcctgaggccagtccgggctgggctgaccacgtggactctcatgcccagattggggccccaatctccctgaagctggggctccagctgtgactcaggggtgggcagaaggggagacagaagcgataggttcctcagcccccagtcccacctgagggcccctttgtcactggatctgataagaaacaccacccctgcagccccctcccctcacctgaccaatggccacagcctggctgggcccagctccctgtatataaggggaccctgggggctgagcactaccaaggccagtcctgagcaggcccaactccagtgcagccgcccaccctgccgccatgtctctgaccaagacttaggggaccatcattgtgtccatgtgggccaagatctccacgcaggccgacaccatcggcaccgagactctggagaggtgagtgtcagatgggactgccagagggactgggtgggaggccaggtatgtgagtggggacagtggggagcgggcagtggggaggggaccgtggggaggggacagtgagtaggagacagtggggagaggacagtggagaggggacagtgaggaggggaccatgggaaggggaccgtggagtggggacagtgaggaggggaccatagggaggggacagtggggaggggacagtgaggaggggaccgtggggaggggacagtgaggaggggaccgtggggaggagacagtgaggaggggaccgtagggaggggacagtgaggaggggaccgtggggaggggacagtgaggaggggaccgtggggaggggacagtgaggaggggaccgtgggaaggagacagtgaggaggggaccttggggaggggacagtgaggaggggaccatggggaggggacagtgaggaggggacaatggagaggggacagtgaggaggggactgtggggagaggacagtgaggaggggaccatggggagggcacagtggggaggggagagtgaggaagggacagtgaggaggggactgtggggaggggacagtggagacagatagccttccctctcagtgaggagggcagggtaaggagggaacgattaggagttgcacaaccatctgggctcgctgagacctgggcaggcacaggcccaggttctgacaagcagagggtgaaaggtttcgttctaggcctgaagggccttacagggcagccagggcactacagcctctaaagtcccagcatctgggatcagggcactgtcccagcttcaaattcccagcatctgatcccctgggaggggccagggagcttttccttccctggaacgctgctgggaggtcatgagcctgcagaaggggtggcgggcaacccagtctggggctgggagggaggtcctgtggccagaggagacggtggaggggctgggggcaccaggcgtgctggaggcggagggcgggagatttggggaccaggctgcacagaacccgtcggaagcagggcgatcagccgggagctgcagaggcctggggggcctctagcccagggcagcctgggaggggcagctgcctgggcacccgggccccgcgaggaggggctggggcctgctgcggggtcgcagatgtgtcccggtgctcggagagggccgcagggcgcgtgggccgtggcgggaggccgcgctgctgggagctcacggcccccgccccccgtcccaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaaggtgcgcggggcgcggtgcgggcggggcggggcggggccgcggggcgggcggggccgcggggcggggtcgcggggcggggcggggtggggtcgcggggcggggcggggtcgcggggcggggcggggcggggcggggcgggcggggcggccggggcccggcggggcggggcggggcggggaggggctgggcggggcggggcgcggggcggggcgggccgggccggggcggggtcgcggggcggggtcgcggggcggggcgcggggcggggcggggcggggtggggtcgcggggcggggcccgggctaggccccgcccccgcactgagccgcccccgcccccagctcctgtcccactgcctgctggtcaccctggccgcgcgcttccccgccgacttcacggccgaggcccacgccgcctgggccaagttcctatcggtcgtatcctctgtcctgaccgagaagtaccgctgagcgccgcctccgggacccccaggacaggctgcggcccctcccctgcccttcaccctcccacagttcctgccctgactccaataaatggatgaggacggagcgatctgggctctgtgttctcagtattggagggaaggaggggagaagctgagtgatgggtccgggggcttcgcaggaactcggtcgtccccactgtcgtcgcggcctggggttcacttggggggcgccttggggaggttctagcccctgagcaccggagctgcggcccgggtggagcggagcagtcccgggccggcccgcggcgtctcctggggtccttgagtcggacgggcgtttgtgcgtctcccggcttcccatatcgcacaaagattgtcacttcactaagcgtattggaagcgtgtcggggctcagggaacttttccacaaagcctgacgtccgaatcccgggactctggcagctacgggggtccctgaggccggtccctccccgactcctaagagagtagggggtttcctgcccggtgttctctctccggttcctcccatgtgctccctcctggcagagcagtaactttacccgaggggagtaaacagatgcccctaaagtctgcagtaaaggtgcccacgcgcaacggcgtgggtcaatgccagaaaccctgggatcccggaggtcgaggcctccacacagacgggaacccgggctggttacgttccccggcgcaggccgagggtccccgcgttcccgccgcgctcgggccgataaggacgggcggggtgcccggaggctctataaggaggccagggcggcgggcgcggcccccagagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggtgcggatccccgggctctgggcggtgtgggcgctagtgaagccccacgcagccgccctcctccccggtcactgacctggtcctgcaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccggtgaggcctttccggccggggcaatggtgcagcgcgcagccggggtgggggggctctgggggtccctagcggggcagaccccgtctcaccggccccttctcctgcagctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctgcccctgcctgtgtggtctttggggagctagcaaagcgaggtcactattgttggccagtgaagctcagggacctaaaaggagcctcctagaactctcaaatgcgccccacccccggaggtttgtcctcccatggcgaggagtgcgatggggcagagggagcactgtgatgtggcgggggtagggagggtggccttcgacttcaacccttgaatcgggcttccaaccatactgttcgcaaagcacttccccattcacgcatttattcattcattctccctccatccccacttcctgctgggacctgtagatgctaatcctggccctttttgcagagagatgcagaaactgaggtcccagagccaaatgtgcaacctaattcgttggcccagagcagagggctccgcagacctgttcctttccccttccttcccccatggacacttcctcagtggcaaacctgcgctagcctggttagccctccctgtgaccctgcagccctggggatgaggtcgggaggaagtcctcagtggccacaatttggcagacagagcaggtttagtcttccagcctgctcaatgacaagctgtgcgaccctgggcgtgtcccagagctctcaggcctttacctatcgaatagaaaaacaacgtccaactcacgagatttttgaaataatttttgaaatcataacacagggtgggtgcctgcagggtcgttgccaccccacccctccacccagccccagctgccgtgtctcaatctctgcaggtgcccaggccaaggcactcccttccccaggttccctcttctccctccccaggactgggaagggaatcttagggctccaccccaggcttttcagacaaagaataggggctgaggaaagagtgggaccttggaggtctccaaaccctgaatagggttggctctgggttggccatcctgggtctgtgtggggagcactggaccaggcctggcacccaggtctgacctggcagtcagcaacgaggtctgaagagagctgctggaagtggagccctgactgtgagtcggccaaactccccccagcagtcagtgccagtgacctgttgccctgcactgcctgggaccccagcccggtagtttggagaacttggccccacgttatctacatcccccaactgtttttttgtttttgggggttttttttttttttgctttgtttttgtttttgagataggcccttgctctgacaccccggctggagtgcagtggcacagttttggctcactgcagcctcaacctcctgggttcaagcgattctcctgcctctgtctcccgtgtagctgggattacaggcatgggccgccattcctggctaatttttgtatttttaatagagacacagtttcaccatgttgatcaggctggtctcaaactcctgacctcaagtgatctgccctcctcggtctcccaaagtgctgggatgacaggcgtgagccaccacacccagcccccgcaactgtttacatggataattaacagctttttgtcccaggcagagtttggtgtgaaagcagcttatgtttcactttggaaaaactgtgctcttctccccatccaggaagctgcctgggtctgggccatatgtggataccttatgggtataagctgctcaggaccctgtgtggaagctcaggacaatgccagcgggaaggctaccatgtggagagctggtctctgtttgggcaggactaagagacgcagggcagccttgggcaacctgtctactctcactcactcctcctcccctttcctgtgccaggcacctcctggcaacttgccagccaatgaccctgcatcccaggcataagagctcctactctcccccacctttcacttttgagcttacacagactcagaaataagctgccgtggtgctgtctcctgaggacaaggctaacaccaaggcggtctgggagaaagttggcaaccacactgctggctatgccacggaggccctggagaggcaagaaccctcctctccctgctcacaccttgggtccaacgcccactccagggctccactggccacccctaactattcttaccctggacccagcccccagcccctcactctttgcttccccctgaagcatgttcctgaccttcctctcacttggccctgagttatggctcagcccagatcaagaaacaatgcaagtaggtggccgacacgctgaccaatgccgtggtccacttagatgacatgcccaatgatgtgtctgagctgaggaagctgcatgtccacgagctgtgggtggacccaggcaacatcagggagagctttgggctgggaggaatctagggtgtgggggcagctggccttcctcataggacagaccctcccacgcgttcagggaggtggagcacaggtggcagtagtatctgcatcccctgactctctctccacagttcctgggtaaatgcctgctggtgacctaggcctgccacacccttcccagtttacccatgtggtgcctccatggacaaattatttgcttttgtgagtgctgtgttgacctaaaaacaccattaagctagagcattggtggtcatgccccctgcctgctgggcctcccaccaggccctcctcccctccctgccccagcacttcctgatctttgaatgaagtccgagtaggcagcagcctgtgtgtgcctgggttctctctgtcccggaatgtgccaacagtggaggtgtttacctgtctcagaccaaggacctctctgcagctgcatggggctggggagggagaactgcagggagtatgggaggggaagctgaggtgggcctgctcaagagaaggtgctgaaccatcccctgtcctgagaggtgccaggcctgcaggcagtggctcagaagctggggaggagagaggcatccagggttctactcagggagtcccagcatcgccaccctcctttgaaatctccctggttgaacccagttaacatacgctctccatcaaaacaaaacgaaacaaaacaaactagcaaaataggctgtccccaatgcaagtgcaggtgccagaacatttctctcattctcaccccttcctgccagagggtaggtggctggagtgagggtgctggccctactcacacttcctgtgtcatggtgaccctctgagagcagcccagtcagtggggaaggaggaaggggctgggatgctcacagccggcagcccacacctggggagactcttcagcagagcaccttgcggccttactcctgcacgtctcctgcagtttgtaaggtgcattcagaactcactgtgtgcccagccctgagctcccagctaattgccccacccagggcctctgggacctcctggtgcttctgcttcctgtgctgccagcaacttctggaaacgtccctgtccccggtgctgaagtcctggaatccatgctgggaagttgcacagcccatctggctctcagccagcctaggaacacgagcagcacttccagcccagcccctgccccacagcaagcctccccctccacactcacagtactgaattgagctttgggtagggtggagaggaccctgtcaccgcttttcttctggacatggacctctctgaattgttggggagttccctccccctctccaccacccactcttcctgtgcctcacagcccagagcattgttatttcaacagaaacactttaaaaaataaactaaaatccgacaggcacggtggctcacacctgtaatcccagtactttgggaggctgaggcgagaggatcacctgaggtcgggagtttgagaccagcctgaccaatatggagaaaccccagttatactaaaaatacaaaattagctgggtgtggtggcgcatgcctgtaatcctagctactaggaaggctgaggcaggagaatcgcttgaacccgggaggtggaggttgaggtgagctgagatcacgccattgcactccagcctgggcaacaagagcaaaactccgtctcaaaaaataaataaataaataaataaataaactaaaatctatccatgctttcacacacacacacacacacacacacacacacccttttttgtgttacttaaagtaggagagtgtctctctttcctgtctcctcacacccacccccagaagagaccaaaatgaagggtttggaactcagcccatgggccccatcccatgctgagggaacacagctacatctacaactactgccacaggctctctttttggacaaaaataccatcatactgtagatacctgtgtacaacttcctattctcagtgaagtgtctcccctgcatccctttcagccagttcattcagctctgcgccattccacagtctcactgattattactatgtttccatcatgatccccccaaaaaatcatgactttatttttttatttttattattattatttttttttttttttttgtgacggagtctcgctctgtcacccaggctggagtgcagtggcacaatctcggctcactgcaagctccacctcgcaggttcacgccattctcctccctcagcctcccgagtagctgagtagctgggactacaggcgccccccactacgcctggctaattttttctatttttaatagagacagagtttcactgcattagcgaggatggtctcgatctcctgacctcgcatctgcccgcctcagcctcccaatgtgctgggattacaggcgtgagccaccgcgcccggccttatgtatttatttttttgagacagagtctcgctgtgtcgtcaggctagagtgctgtggcacgatctcggctcactgcaacctccaactccctggttcaaaggattctccagcctccacctcccgagtagctgggattacaggcgtgcaccaccacacccagctaatttttgtatttttagtagagacggggtttctccatgttggtcagcctggtctcgaactcccgacctcagctgatccacccgccttggcctcccaaagtgctgggattacaggcgtgagccaccgagcctggccaaaccatcacttttcatgagcagggatgcacccactggcactcctgcacctcccaccctccccctcgccaagtccaccccttccttcctcaccccacatcccctcacctacattctgcaaccacaggggccttctctcccctgtcctttccctacccagagccaagtttgtttatctgtttacaaccagtatttacctagcaagtcttccatcagatagcatttggagagctgggggtgtcacagtgaaccacgacctctaggccagtgggagagtcagtcacacaaactgtgagtccatgacttggggcttagccagcacccaccaccccacgcgccaccccacaaccccgggtagaggagtctgaatctggagccgcccccagcccagccccgtgctttttgcgtcctggtgtttgttccttcccggtgcctgtcactcaagcacactagtgactatcgccagagggaaagggagctgcaggaagcgaggctggagagcaggaggggctctgcgcagaaattcttttgagttcctatgggccagggcgtccgggtgcgcgcattcctctccgccccaggattgggcgaagccctccggctcgcactcgctcgcccgtgtgttccccgatcccgctggagtcgatgcgcgtccagcgcgtgccaggccggggcgggggtgcgggctgactttctccctcgctagggacgctccggcgcccgaaaggaaagggtggcgctgcgctccggggtgcacgagccgacagcgcccgaccccaacgggccggccccgccagcgccgctaccgccctgcccccgggcgagcgggatgggcgggagtggagtggcgggtggagggtggagacgtcctggcccccgccccgcgtgcacccccaggggaggccgagcccgccgcccggccccgcgcaggccccgcccgggactcccctgcggtccaggccgcgccccgggctccgcgccagccaatgagcgccgcccggccgggcgtgcccccgcgccccaagcataaaccctggcgcgctcgcgggccggcactcttctggtccccacagactcagagagaacccaccatggtgctgtctcctgccgacaagaccaacgtcaaggccgcctggggtaaggtcggcgcgcacgctggcgagtatggtgcggaggccctggagaggtgaggctccctcccctgctccgacccgggctcctcgcccgcccggacccacaggccaccctcaaccgtcctggccccggacccaaaccccacccctcactctgcttctccccgcaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaaggtgagcggcgggccgggagcgatctgggtcgaggggcgagatggcgccttcctctcagggcagaggatcacgcgggttgcgggaggtgtagcgcaggcggcggctgcgggcctgggccgcactgaccctcttctctgcacagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcagcagcctgtgtgtgcctgggttctctctatcccggaatgtgccaacaatggaggtgtttacctgtctcagaccaaggacctctctgcagctgcatggggctggggagggagaactgcagggagtatgggaggggaagctgaggtgggcctgctcaagagaaggtgctgaaccatcccctgtcctgagaggtgccaggcctgcaggcagtggctcagaagctggggaggagagaggcatccagggttctactcagggagtcccagcatcgccaccctcctttgaaatctccctggttgaacccagttaacatacgctctccatcaaaacaaaacgaaacaaaacaaactagcaaaataggctgtccccagtgcaagtgcaggtgccagaacatttctctcattcccaccccttcctgccagagggtaggtggctggagtgagggtgctggccctactcacacttcctgtgtcacggtgaccctctgagagcagcccagtcagtggggaaggaggaaggggctgggatgctcacagccggcagcccacacctggggagactcttcagcagagcaccttgcggccttactcctgcacgtctcctgcagtttgtaaggtgcattcagaactcactgtgtgcccagccctgagctcccagctaattgccccacccagggcctctgggacctcctggtcttctgcttcctgtgctgccagcaacttctggaaacgtccctgtccccggtgctgaagtcctggaatccatgctgggaagttgcacagcccatctggctctcagccagcctaggaacatgagcagcacttccaacccagtccctgccccacagcaagcctccccctccacactcacagtactggattgagctttggggagggtggagaggaccctgtcactgctttccttctggacatggacctctctgaattgttggggagttccctcccctctccaccacccgctcttcctgcgcctcacagcccagagcattgttatttcagcagaaacactttaaaaaataaactaaaatccgacaggcacggtggctcacgcctgtaatcccagcactttgggaggccgaggtgggaggatcacctgaggtcgggagtttgagaccaccctgatcaacatgtagaaaccccatctatactaaaaatacaaaatcagccgggcatggtggcccatgcctgtaaacccacctactccggaggctgaggcaggagaatcattttaaccaaggaggcagaggttgcagtgagctaagatcacaccattgcactccagcctggaaaacaacagcgaaactccgcctcaaaaaaaaaaaagcccccacatcttatcttttttttttccttcaggctgtgggcagagtcagaagagggtggcagacagggaggggaaatgagaagatccaacgggggaagcattgctaagctggtcggagctacttccttctctgcccaaggcagcttaccctggcttgctcctggacacccagggcagggcctgagtaagggcctggggagacagggcagggagcaggctgaagggtgctgacctgatgcactcctcaaagcaagatcttctgccagacccccaggaaatgacttatcagtgatttctcaggctgttttctcctcagtaccatccccccaaaaaacatcacttttcatgcacagggatgcacccactggcactcctgcacctcccacccttccccagaagtccaccccttccttcctcaccctgcaggagctggccagcctcatcaccccaacatctccccacctccattctccaaccacagggcccttgtctcctctgtcctttcccctccccgagccaagcctcctccctcctccacctcctccacctaatacatatccttaagtctcacctcctccaggaagccctcagactaaccctggtcaccttgaatgcctcgtccacacctccagacttcctcagggcctgtgatgaggtctgcacctctgtgtgtacttgtgtgatggttagaggactgcctacctcccagaggaggttgaatgctccagccggttccagctattgctttgtttacctgtttaaccagtatttacctagcaagtcttccatcagatagcatttggagagctgggggtgtcacagtgaaccacgacctctaggccagtgggagagtcagtcacacaaactgtgagtccatgacttggggcttagccagcacccaccaccccacgcgccaccccacaaccccgggtagaggagtctgaatctggagccgcccccagcccagccccgtgctttttgcgtcctggtgtttattccttcccggtgcctgtcactcaagcacactagtgactatcgccagagggaaagggagctgcaggaagcgaggctggagagcaggaggggctctgcgcagaaattcttttgagttcctatgggccagggcgtccgggtgcgcgcattcctctccgccccaggattgggcgaagcctcccggctcgcactcgctcgcccgtgtgttccccgatcccgctggagtcgatgcgcgtccagcgcgtgccaggccggggcgggggtgcgggctgactttctccctcgctagggacgctccggcgcccgaaaggaaagggtggcgctgcgctccggggtgcacgagccgacagcgcccgaccccaacgggccggccccgccagcgccgctaccgccctgcccccgggcgagcgggatgggcgggagtggagtggcgggtggagggtggagacgtcctggcccccgccccgcgtgcacccccaggggaggccgagcccgccgcccggccccgcgcaggccccgcccgggactcccctgcggtccaggccgcgccccgggctccgcgccagccaatgagcgccgcccggccgggcgtgcccccgcgccccaagcataaaccctggcgcgctcgcggcccggcactcttctggtccccacagactcagagagaacccaccatggtgctgtctcctgccgacaagaccaacgtcaaggccgcctggggtaaggtcggcgcgcacgctggcgagtatggtgcggaggccctggagaggtgaggctccctcccctgctccgacccgggctcctcgcccgcccggacccacaggccaccctcaaccgtcctggccccggacccaaaccccacccctcactctgcttctccccgcaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaaggtgagcggcgggccgggagcgatctgggtcgaggggcgagatggcgccttcctcgcagggcagaggatcacgcgggttgcgggaggtgtagcgcaggcggcggctgcgggcctgggccctcggccccactgaccctcttctctgcacagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggcagcctgtgtgtgcctgagttttttccctcagcaaacgtgccaggcatgggcgtggacagcagctgggacacacatggctagaacctctctgcagctggatagggtaggaaaaggcaggggcgggaggaggggatggaggagggaaagtggagccaccgcgaagtccagctggaaaaacgctggaccctagagtgctttgaggatgcatttgctctttcccgagttttattcccagacttttcagattcaatgcaggtttgctgaaataatgaatttatccatctttacgtttctgggcactcttgtgccaagaactggctggctttctgcctgggacgtcactggtttcccagaggtcctcccacatatgggtggtgggtaggtcagagaagtcccactccagcatggctgcattgatcccccatcgttcccactagtctccgtaaaacctcccagatacaggcacagtctagatgaaatcaggggtgcggggtgcaactgcaggccccaggcaattcaataggggctctactttcacccccaggtcaccccagaatgctcacacaccagacactgacgccctggggctgtcaagatcaggcgtttgtctctgggcccagctcagggcccagctcagcacccactcagctcccctgaggctggggagcctgtcccattgcgactggagaggagagcggggccacagaggcctggctagaaggtcccttctccctggtgtgtgttttctctctgctgagcaggcttgcagtgcctggggtatcagagggagggttcccggagctggtagccataaagccctggccctcaactgataggaatatcttttattccctgagcccatgaatcacccttggtaaacacctatggcaggccctctgcctgcgtttgtgatgtccttcccgcagcctgtgggtacagtatcaactgtcaggaagacggtgtcttcgttatttcatcaggaagaatggaggtctgacctaaaggtagaaatatgtcaaatgtacagcagagggctggttggagtgcagcgctttttacaattaattgatcagaaccagttataaatttatcatttccttctccactcctgctgcttcagttgactaagcctaagaaaaaattataaaaattggccgggcgcggtggctcacacctgtaattgcagcactttgccaggcttaggcaggtggatcacctgaagtcaggggttcgagaccagcctagccaacatagtgaaaccctgtctctactaaaaagacaaaaattgtccaggtgtgatgactcatgcctgtaaacctggcactttgggaggcggaggttgtagtgagtcaagatcgcgccatcgcactccagcttgggcaacaagagcgaaactctgtctcaaaaaaaaatttaatctaatttaatttaatttaaaaattagcacggtggttgggcacagtggctcacgcctgtaatcccagcactttgggaagccaaggtgggcagatcacaaggtcaggaattcgagaccagcctggccaatatggggaaaccccatctctactaaaaatacaaaaaattagccgggtgtggtggcgcacgcctgtaatcccagctactcgggaggttgaggtaggagaatcacttgaacccaggaggcagaggttgcagtgacccgagatcacaccattgcactctagcctgggcaacaagagcaaaactccatctcaaaaaaaattataaaaattatacatcagtagatgaatgggtaaacaaaatgtggtggtctatacacacaatggaatattatttggccacaaaaagaaatgaagcactgataggatgtagctgcaccctgaaaatatttgacaagtaaaagaagccggacaccaaaggtcacaaactgcatgaccccatctatatgcaatatccgctacagccaaatccatagggaccaaaagcggattagtggctgccggggccagagttactgttaatgagtaccgaggtggcgtttgggatgatgaaaaagttctgacctagatagtggtgatggctgcataacactaagtgttcttaatatcaccaaattttatacctgaaaaatggctacaatggtaatttatgtctattttatcaccttttttaaaacaaaaaagatataaggggtacagcagagtgagtgctgcatatgcatttactattattcttgggttacatcccaggtactcaataaatgttcactgccctgaagaaacacctgctacgagtcaggcacctcacagttgttatccgtttaattctcacaatctgagaagaaactgtcaccctcattttatataataaatgagaaaacagactcgggcaagtgtcacaatagaatcaagaggcagaataaactgacttccaatgccaaatccatgccgaaattcagtgctataataatgtacatggccgggcgcggtggttcacgcctgtaatcccagaactttgggaggctgaggcgggaggatcacctgaggtcgggagtttgagatcagcctaacacggtgaaaccctgtctctactaaaaatacaaaattggcatggtggcatgcacctgtgatcccagttactcgggaggctgaggcaggagaatcgtttgaacccgggaggcggaggttgcagtgagccggaatggcgccactgcactcaccgcacccggccaatttttgtgtttttagtagagactaaataccatatagtgaacacctaagacggggggccttggatccagggcgattcagagggccccggtcggagctgtcggagattgagcgcgcgcggtcccgggatctccgacgaggccctggacccccgggcggcgaagctgcggcgcggcgccccctggaggccgcgggacccctggccggtccgcgcaggcgcagcggggtcgcagggcgcggcgggttccagcgcggggatggcgctgtccgcggaggaccgggcgctggtgcgcgccctgtggaagaagctgggcagcaacgtcggcgtctacacgacagaggccctggaaaggtgcggcaggctgggcgcccccgcccccaggggccctccctccccaagccccccggacgcgcctcacccacgttcctctcgcaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccaggtgagcggctgccgtgctgggcccctgtccccgggagggccccggcggggtgggtgcggggggcgtgcggggcgggtgcaggcgagtgagccttgagcgctcgccgcagctcctgggccactgcctgctggtaaccctcgcccggcactaccccggagacttcagccccgcgctgcaggcgtcgctggacaagttcctgagccacgttatctcggcgctggtttccgagtaccgctgaactgtgggtgggtggccgcgggatccccaggcgaccttccccgtgtttgagtaaagcctctcccaggagcagccttcttgccgtgctctctcgaggtcaggacgcgagaggaaggcgccgcccctccccaaggaaaggcgagggcctggggcacacccccagtgcccagatccaggcgcgcctctttccacctccagcaggtttggggcctcggccatgggggcaccgaactgcgtgcagcctgaccctcccgaatggggtggtaggtgagggccgcgggacgccccgggcggcgggctgcgaggacggccgactctgcccatcccgagggcggctggcttcgccctccccactctgcgccgagcacgcggcccggacccaccgcgagaactccgcacctgcagcgtgaacgcacgcgggcggcgttaagggcccggggctgactcggagcaggttagggaacagcgccccctcccggcgcgagccggtacctgcgcagcacccagccgccgcggctgtggcctggaatcggggacctggggtgccggggggttgtggtgaaggaggtgggaccagccccagcacctagccacgtagctggcgaggtggaccaggaaccgacccagacccctgccgtcacccgacatcactacggagagtgaagcttttttatatttgtccacataaaaccaatcatggtcattgtagaacttccgaaaacaaggcttgctgcaccttcctgtgtatcccaggtccaggaatgggtgcagcacatccttcagctgccgcttgacacgcggcaaactgtgtcatgtgtaaacaagaacaggacatggctgtcatatccaagagcacatgtgtaacacagacatgccacacacacacacacacacacacggggtagaggcaggcctcatccacacccctaacatttgatgcgtagctgttccagtcttctaggcacatgtagagatgcttttcctcagaaatggtattctcaaggtgacactgaggaaaagtggacaggccgggcgcggtggctcacgcctgtaatcccagcactccgggaggccgaggcgggcggatc
